United States Patent 10,982,187 (BOS TAURUS VARIETY 'HO840003150607238' AND METHODS OF USE THEREOF) - sequence listing, part 7

SEQ ID NO: 105743 - DNA, 201 bp, Bos taurus
tgagctttcacagaagaagccagcttatttagactatggaatattctacacgctggatttggttgtttcttgtattaccctttaacttcgtcctttatcacagctaatacctcccataaagagagtgagaccagaggtctgacagctatgttgcctttttcacactggtttgctctctgaacttcattcttctgccggggt

SEQ ID NO: 105744 - DNA, 201 bp, Bos taurus; identical to SEQ ID NO: 24633

SEQ ID NO: 105745 - DNA, 201 bp, Bos taurus
atgcagatgagttgagagaaaagtctgctggacagctctcaaaagaagtaaagcaaagagattctgggaagatggtttatagactacaggcctcttcctaatctgtcagttttttcctatctgcatttcctgagccagaaacaagaagcctctagctctctttgagatctagcagagagaaatggtgtgtggcctttagca

SEQ ID NO: 105746 - DNA, 201 bp, Bos taurus
tctgctgagtccaaggtggtccaaagagaagagtagacgaagtgctctctcatctccttaaaaataaccaaacccgcttaacctcccagggctgagaaagagagaaacaagcctatgtatcaccctttaaccagcagacagttttcttatacaaagcagactcagttagaaacctgaaatttggctagataaattaaaact

SEQ ID NO: 105747 - DNA, 201 bp, Bos taurus
aaattgtttgaagaaagtaatcctggggttttagatgtctctatagcctgctgaaattaagttaagtctatagtacactaggttacccactccagcattcatgcctggagagttccaaggatgcaggagactggcaggctacaatccatggggtcataaagaataggacacaactgagtgactaacacacacacacacaca

SEQ ID NO: 105748 - DNA, 201 bp, Bos taurus; identical to SEQ ID NO: 24634

SEQ ID NO: 105749 - DNA, 201 bp, Bos taurus; identical to SEQ ID NO: 24636

SEQ ID NO: 105750 - DNA, 201 bp, Bos taurus; identical to SEQ ID NO: 24637

SEQ ID NO: 105751 - DNA, 201 bp, Bos taurus; identical to SEQ ID NO: 24638

SEQ ID NO: 105752 - DNA, 201 bp, Bos taurus; identical to SEQ ID NO: 24639

SEQ ID NO: 105753 - DNA, 201 bp, Bos taurus; identical to SEQ ID NO: 24640

SEQ ID NO: 105754 - DNA, 201 bp, Bos taurus; identical to SEQ ID NO: 24641

SEQ ID NO: 105755 - DNA, 201 bp, Bos taurus; identical to SEQ ID NO: 24642

SEQ ID NO: 105756 - DNA, 201 bp, Bos taurus; identical to SEQ ID NO: 24643

SEQ ID NO: 105757 - DNA, 201 bp, Bos taurus; identical to SEQ ID NO: 24644

SEQ ID NO: 105758 - DNA, 201 bp, Bos taurus; identical to SEQ ID NO: 24645

SEQ ID NO: 105759 - DNA, 201 bp, Bos taurus; identical to SEQ ID NO: 24646

SEQ ID NO: 105760 - DNA, 201 bp, Bos taurus; identical to SEQ ID NO: 24647

SEQ ID NO: 105761 - DNA, 201 bp, Bos taurus; identical to SEQ ID NO: 24655

SEQ ID NO: 105762 - DNA, 201 bp, Bos taurus; identical to SEQ ID NO: 24659

SEQ ID NO: 105763 - DNA, 201 bp, Bos taurus; identical to SEQ ID NO: 24660

SEQ ID NO: 105764 - DNA, 201 bp, Bos taurus; identical to SEQ ID NO: 24662

SEQ ID NO: 105765 - DNA, 201 bp, Bos taurus; identical to SEQ ID NO: 24663

SEQ ID NO: 105766 - DNA, 201 bp, Bos taurus; identical to SEQ ID NO: 24669

SEQ ID NO: 105767 - DNA, 201 bp, Bos taurus; identical to SEQ ID NO: 24674

SEQ ID NO: 105768 - DNA, 201 bp, Bos taurus; identical to SEQ ID NO: 24675

SEQ ID NO: 105769 - DNA, 201 bp, Bos taurus; identical to SEQ ID NO: 24677

SEQ ID NO: 105770 - DNA, 201 bp, Bos taurus; identical to SEQ ID NO: 24678

SEQ ID NO: 105771 - DNA, 201 bp, Bos taurus; identical to SEQ ID NO: 24680

SEQ ID NO: 105772 - DNA, 201 bp, Bos taurus; identical to SEQ ID NO: 24683

SEQ ID NO: 105773 - DNA, 201 bp, Bos taurus; identical to SEQ ID NO: 24687

SEQ ID NO: 105774 - DNA, 201 bp, Bos taurus; identical to SEQ ID NO: 24688

SEQ ID NO: 105775 - DNA, 201 bp, Bos taurus; identical to SEQ ID NO: 24689

SEQ ID NO: 105776 - DNA, 201 bp, Bos taurus; identical to SEQ ID NO: 24692

SEQ ID NO: 105777 - DNA, 201 bp, Bos taurus; identical to SEQ ID NO: 24694

SEQ ID NO: 105778 - DNA, 201 bp, Bos taurus; identical to SEQ ID NO: 24695

SEQ ID NO: 105779 - DNA, 201 bp, Bos taurus; identical to SEQ ID NO: 24696

SEQ ID NO: 105780 - DNA, 201 bp, Bos taurus; identical to SEQ ID NO: 24697

SEQ ID NO: 105781 - DNA, 201 bp, Bos taurus; identical to SEQ ID NO: 24698

SEQ ID NO: 105782 - DNA, 201 bp, Bos taurus; identical to SEQ ID NO: 24700

SEQ ID NO: 105783 - DNA, 201 bp, Bos taurus; identical to SEQ ID NO: 24701

SEQ ID NO: 105784 - DNA, 201 bp, Bos taurus; identical to SEQ ID NO: 24702

SEQ ID NO: 105785 - DNA, 201 bp, Bos taurus; identical to SEQ ID NO: 24703

SEQ ID NO: 105786 - DNA, 201 bp, Bos taurus; identical to SEQ ID NO: 24704

SEQ ID NO: 105787 - DNA, 201 bp, Bos taurus; identical to SEQ ID NO: 24705

SEQ ID NO: 105788 - DNA, 201 bp, Bos taurus
gtttgggccagttcaattacctcaattattcatagttctatttctgtgatcacgttttgagaagtgtgataccaacatgtcaccacagattcatgccccatgaaaacatgcaaatgggattttgaaaaatgcaaataaggatccataacccatgcccatccataaaggaagcttgattgtgtctctttaggcaacattttt

SEQ ID NO: 105789 - DNA, 201 bp, Bos taurus
tcactctacgcccaaattgaaatggtctgccacagtcttcacttacagcaacttgccagaagttcacacagcattcttctgtgtcatcctacacccacggagtcatgtggctgaagtagctgagcagtttgcatgtcaaccacatattatagcaatcttcttttcatttcacacaaaggaaacaaatcaaagcaaaaaaat

SEQ ID NO: 105790 - DNA, 201 bp, Bos taurus
aaatatattatttaacttttttcaagttctcagatgttaacatattttatcttgatttttactgggatgatagaaaaactttgcaataaagtttaatatttaattcagttcatttattttcccatgtgataatctgtgttaattttttcccttaattctgaaactataaatcctatgtcctaagaatactagaaattgaaa

SEQ ID NO: 105791 - DNA, 201 bp, Bos taurus; identical to SEQ ID NO: 24709

SEQ ID NO: 105792 - DNA, 201 bp, Bos taurus; identical to SEQ ID NO: 24710

SEQ ID NO: 105793 - DNA, 201 bp, Bos taurus; identical to SEQ ID NO: 24711

SEQ ID NO: 105794 - DNA, 201 bp, Bos taurus; identical to SEQ ID NO: 24712

SEQ ID NO: 105795 - DNA, 201 bp, Bos taurus; identical to SEQ ID NO: 24713

SEQ ID NO: 105796 - DNA, 201 bp, Bos taurus; identical to SEQ ID NO: 24714

SEQ ID NO: 105797 - DNA, 201 bp, Bos taurus
accctcctccctcctccctccccataccctccctctgggtcatcgcagtgcaccagccccaagcatccagtatcgtgcatcgaacctggactggcgactcattagaaatcactgactagctttacgaacgtgaaacttcgttcaagttttctttttttcttttttttttaaacttgatttattttagtttacttttggcca

SEQ ID NO: 105798 - DNA, 201 bp, Bos taurus; identical to SEQ ID NO: 24715

SEQ ID NO: 105799 - DNA, 201 bp, Bos taurus; identical to SEQ ID NO: 24716

SEQ ID NO: 105800 - DNA, 201 bp, Bos taurus; identical to SEQ ID NO: 24717

SEQ ID NO: 105801 - DNA, 201 bp, Bos taurus; identical to SEQ ID NO: 24718

SEQ ID NO: 105802 - DNA, 201 bp, Bos taurus
tcgactctgtattggtgtcctgatatccagaagtcaaaaccagactggtggtagacacccatatttcaaggaagcaggtctggcttccttttttctctctgtttgaacaactggtgcatttaatagagaactgtgttcatcttttcaaactcgctttccacttttgtattttcttcttctcatgatatttttcaggaaaag

SEQ ID NO: 105803 - DNA, 201 bp, Bos taurus
gactctgctaccacagcctccttcccaggccagggaactgggctattccagttccttttctccaattagacttccaaaggaagtcacttcatctgggcctaaagtttttatctacagttgctacctggatttaaaatcccaacttctccccacagttcagtcgctcagtcatgtctgactcttcgcgaccccatgaatcgc

SEQ ID NO: 105804 - DNA, 201 bp, Bos taurus; identical to SEQ ID NO: 24720

SEQ ID NO: 105805 - DNA, 201 bp, Bos taurus; identical to SEQ ID NO: 24721

SEQ ID NO: 105806 - DNA, 201 bp, Bos taurus; identical to SEQ ID NO: 24722

SEQ ID NO: 105807 - DNA, 201 bp, Bos taurus; identical to SEQ ID NO: 24723

SEQ ID NO: 105808 - DNA, 201 bp, Bos taurus
atttgtaatcataaagaaataaaatactttaaagtaaatgaaatcctaaagaaatgaatatcctacatttcaaatctagggggatactagtgatcagtattaaaaggaagatgtataggcttggtggctcagacggtaaagcgtctgtctacaatgcgggagaccaggattcgatccctgggttgggaagatcccctgcag

SEQ ID NO: 105809 - DNA, 201 bp, Bos taurus
tgttactgcaaagcaccttccaaatgtcagctgacttaaaacaatcagggcggtacatgcaaaaatggattctgaagagcgttttttgatcaaaagacacttgcctagacttctgactagaattaggaatcagtgtatctgtgtgatggaaattcctctatgtgtcctactcagtaaacccaaactcctctcatcctgtcc

SEQ ID NO: 105810 - DNA, 201 bp, Bos taurus
tcagccattttgggagcttattttaccatgaggatgctggtgctgtcaagtgccattctggaatccttcctctggattattagcactgggaactggccttgcctgctagtctaccagtgccagtactaccctcagcctaagtgcctaccttggcaggaacacacgcccacccaccagcaggccagctgccttaaggcctcc

SEQ ID NO: 105811 - DNA, 201 bp, Bos taurus; identical to SEQ ID NO: 24726

SEQ ID NO: 105812 - DNA, 201 bp, Bos taurus
actgatcagattatgggctaggaatgtcaggttgggacaaatcaatatctctcaatttgggaagataggaaagatactttatcataccgttgatccagcattggagtttcgctgggcaggatatgggtgccaggaaatggaaagtgtggatgagaatgaaataaatccaagcaatcaataacagactctagggaggatgag

SEQ ID NO: 105813 - DNA, 201 bp, Bos taurus; identical to SEQ ID NO: 24729

SEQ ID NO: 105814 - DNA, 201 bp, Bos taurus
ctacagccacagtgtgtaataattacttagttaagatggcattaaatttgcacaggaagatattttgagagagagactgcgttcatgtagcttttattacattgtattgttataactgttctattttatttttagtagttgttagcttcttcagtttggagaaggcaatggcaacccaatccagtactcttgcctggaaaa

SEQ ID NO: 105815 - DNA, 201 bp, Bos taurus; identical to SEQ ID NO: 24730

SEQ ID NO: 105816 - DNA, 201 bp, Bos taurus; identical to SEQ ID NO: 24731

SEQ ID NO: 105817 - DNA, 201 bp, Bos taurus; identical to SEQ ID NO: 24733

SEQ ID NO: 105818 - DNA, 201 bp, Bos taurus; identical to SEQ ID NO: 24734

SEQ ID NO: 105819 - DNA, 201 bp, Bos taurus
cttggcgctcttcacggcattgccgcctctgttggtgtgagcagttcctgaagaaaaggggcttcttgtgctgaggcttcaactccccacccatcagtcctagggcccagtgtagaccacagcctctctgcccctgcagaagagagctcacgaggagtccagccagtttcctctcccacaggaagtaggagctgcgtatgt

SEQ ID NO: 105820 - DNA, 201 bp, Bos taurus; identical to SEQ ID NO: 24735

SEQ ID NO: 105821 - DNA, 201 bp, Bos taurus
aattttgttaattttacctcagtagaaccagaaggaaaaaaaagattggactccatggggtagagttggagcagtaggtggaaagttacagagtgacagacttcagcacagaagcagccaaatgtgagatcgaccagcttcagcaggaggatttctttgtcagaagtttttgagcaggagctgggtaaaccctgggaaaag

SEQ ID NO: 105822 - DNA, 201 bp, Bos taurus; identical to SEQ ID NO: 24737

SEQ ID NO: 105823 - DNA, 201 bp, Bos taurus
tgtgggggccgggcaccttacatggccaggcttcagagccacgaagccgtcttaccagtcatagatgtcaccatcgcaggtgacaggagtaacctggagcattaggggcctcactactcaaatcctgtagtttccattttgaacagctctcaaatctctccagtgtctgtcctcgcagctcctaccataggccaggccatc

SEQ ID NO: 105824 - DNA, 201 bp, Bos taurus
aacaaggtctccaaattggctgccaccagtatatctgtccccaaggggtgttccagttgcctcttgcctctccaagagactatccaagatctgcaagagggctgaccatggttcctttcaaatgatcatctctgcactgggttggaacatgagattttgcatatacccttcaagtgcaaagtctctgtttcctacagtcct

SEQ ID NO: 105825 - DNA, 201 bp, Bos taurus
ccatgaaaggtcacgacagaagcagacaggagggaatgtaaacacctaactctcatgaacgggtctgagaccaccagtcatttcactgcttcagggggccatgtatctagggacggtctcggtagggcttctggttggaatggggcaacctctgtggtggttgggagacagccggccatttcctcttggtccccctcactg

SEQ ID NO: 105826 - DNA, 201 bp, Bos taurus; identical to SEQ ID NO: 24740

SEQ ID NO: 105827 - DNA, 201 bp, Bos taurus
tggtgatggaaaacttaggccacagtacttaaacaataagaagccattgtagggttttaatttgggagaggataataacagatttatttgaaaaaattcaggagaataggttgaaagtggccagaagtaaggaaaccagagtgaaggctagtgcaatcattcagttgggaggttatgatagcttggattaggaaaaagtag

SEQ ID NO: 105828 - DNA, 201 bp, Bos taurus
ggattaagttactgtctgtacatctacctctgaacagcgccacagagcgagaaaaagacaggagcccgaacaggaagagtgttcctaacgccagccaattcgacgtcacggtataatgctccaggcggtatcgctgaaacacgaagtggtaacatttctagaaagaaagaaaactgctctgaaaaaaagatacaccttgca

SEQ ID NO: 105829 - DNA, 201 bp, Bos taurus; identical to SEQ ID NO: 24742

SEQ ID NO: 105830 - DNA, 201 bp, Bos taurus; identical to SEQ ID NO: 24743

SEQ ID NO: 105831 - DNA, 201 bp, Bos taurus; identical to SEQ ID NO: 24744

SEQ ID NO: 105832 - DNA, 201 bp, Bos taurus; identical to SEQ ID NO: 24745

SEQ ID NO: 105833 - DNA, 201 bp, Bos taurus; identical to SEQ ID NO: 24746

SEQ ID NO: 105834 - DNA, 201 bp, Bos taurus; identical to SEQ ID NO: 24747

SEQ ID NO: 105835 - DNA, 201 bp, Bos taurus; identical to SEQ ID NO: 24750

SEQ ID NO: 105836 - DNA, 201 bp, Bos taurus; identical to SEQ ID NO: 24751

SEQ ID NO: 105837 - DNA, 201 bp, Bos taurus; identical to SEQ ID NO: 24752

SEQ ID NO: 105838 - DNA, 201 bp, Bos taurus; identical to SEQ ID NO: 24753

SEQ ID NO: 105839 - DNA, 201 bp, Bos taurus
tctgaaaagatctctcaggaagaaattagtagaagggttccagaaagcacccacgtcctagtttccagcttgccttatcaagagaggcctcctgctcttttcctttcaccctccctcctgtctgtatgcttggctacccacacctcctccccacagcctcctacggcctgtctcatgcatgccccatgcatgtaacacagt

SEQ ID NO: 105840 - DNA, 201 bp, Bos taurus; identical to SEQ ID NO: 24756

SEQ ID NO: 105841 - DNA, 201 bp, Bos taurus
ggaggatcagctgggcaacgtgctttgctgggtgaggctggggcaccatatggtgcttatgaaactgtcattagccgaggtggcagtggtgaatgggggaagaggggggcaggggcgagcagaacacagaccagcgttattctgaaggaaaaagcaggatgtaccatttatccataacaaggaaagaatgaaatttctacc

SEQ ID NO: 105842 - DNA, 201 bp, Bos taurus; identical to SEQ ID NO: 24760

SEQ ID NO: 105843 - DNA, 201 bp, Bos taurus; identical to SEQ ID NO: 24765

SEQ ID NO: 105844 - DNA, 201 bp, Bos taurus; identical to SEQ ID NO: 24766

SEQ ID NO: 105845 - DNA, 201 bp, Bos taurus; identical to SEQ ID NO: 24767

SEQ ID NO: 105846 - DNA, 201 bp, Bos taurus; identical to SEQ ID NO: 24769

SEQ ID NO: 105847 - DNA, 201 bp, Bos taurus
ctgaggataccaaaaaagagaggaccaggcccctgggccaatgtcctctgtgcttttgacctggtatacagattactccaaaaaaaaaaaaaaaaaaaaaactgtccaaggcctgtttaccacttcagtatagaaagcggctctcagttctcaatttcatatataagagactatgttttaagatacaaagtctatatcaaa

SEQ ID NO: 105848 - DNA, 201 bp, Bos taurus; identical to SEQ ID NO: 24770

SEQ ID NO: 105849 - DNA, 201 bp, Bos taurus; identical to SEQ ID NO: 24771

SEQ ID NO: 105850 - DNA, 201 bp, Bos taurus; identical to SEQ ID NO: 24772

SEQ ID NO: 105851 - DNA, 201 bp, Bos taurus; identical to SEQ ID NO: 24773

SEQ ID NO: 105852 - DNA, 201 bp, Bos taurus; identical to SEQ ID NO: 24775

SEQ ID NO: 105853 - DNA, 201 bp, Bos taurus; identical to SEQ ID NO: 24776

SEQ ID NO: 105854 - DNA, 201 bp, Bos taurus; identical to SEQ ID NO: 24777

SEQ ID NO: 105855 - DNA, 201 bp, Bos taurus
cacgactgaagtgacttagcagagcagagcagaagataatcttcagaagtactgtttccttgaccaatctgaaaaatcctaggacagattcgataggcccggtttgggtcatgtgtccatccttgaaccagtctttggtgagggagatggagtattctgattggtcaggcccaaccctagcgctattgacaatgacgtcaa

SEQ ID NO: 105856 - DNA, 201 bp, Bos taurus
ggccacagcaggggcctctaaagtgcaggcccaaagttggagccccccttgctcttgtctttgcatgcattacactcagtgactgtttattgaccatttactataggccagacactgtcagagattcagatcagtcgctcagttgtgtctgactctttgccacctcctgaatcacagcacgccaggcctccctatccatca

SEQ ID NO: 105857 - DNA, 201 bp, Bos taurus; identical to SEQ ID NO: 24779

SEQ ID NO: 105858 - DNA, 201 bp, Bos taurus
tccctgggacgctcctgtccaaggtcctcgcctcctctctctcacgttctcccaaggtgaggtcatcttcctgtggctttaattaccatctagaggcccacgaccgcctctccagtgcgggcttgtctcaagagccagagacccatccatggagcagcttgtgaacgtctgcggacggaagcctcacggcccttccgtctc

SEQ ID NO: 105859 - DNA, 201 bp, Bos taurus; identical to SEQ ID NO: 24781

SEQ ID NO: 105860 - DNA, 201 bp, Bos taurus; identical to SEQ ID NO: 24782

SEQ ID NO: 105861 - DNA, 201 bp, Bos taurus; identical to SEQ ID NO: 24783

SEQ ID NO: 105862 - DNA, 201 bp, Bos taurus; identical to SEQ ID NO: 24784

SEQ ID NO: 105863 - DNA, 201 bp, Bos taurus; identical to SEQ ID NO: 24785

SEQ ID NO: 105864 - DNA, 201 bp, Bos taurus; identical to SEQ ID NO: 24786

SEQ ID NO: 105865 - DNA, 201 bp, Bos taurus
ttgagagggacacatgggtgatatttacatcctcaactgcattatctgggaagtgggtgttttaactacttcctttttacggactaagaacacacagccctagagaggccagcacctagaagcacgaggatttgaaaccaggtctgtttcctccaggagctctcccactggaaaggcagacagatggcagaagttatttta

SEQ ID NO: 105866 - DNA, 201 bp, Bos taurus
cctccagtggtaccacatgctgctgtgcaaacagagcacgtggtccggccaaacaaaggaacatgtgtgtgtgttgcaaaccacccccctatcacgggagcgcgagctccgccaggagagggcccggcccgcgcgcgcgcgcgcgctataatttttcactgcagttgaaacaccccgtaagctctcaggaagcagcggggg

SEQ ID NO: 105867 - DNA, 201 bp, Bos taurus
gctacctttgagcctgagttggaaatggagccaagggggaatctgagatgtaattcgggaatacactaatgatttccaataaactggtaaaatataaagacgacaatttcacagtctccactcaattctgaagctctggacattggctagaccctgtgttttctttggtcatattattcttttttaaattgtagtataatt

SEQ ID NO: 105868 - DNA, 201 bp, Bos taurus
ctatggggtcgcacagagtcagacacgactgaagcgacttagcagcagcagcagcagcagttcattgggatcaatattaggggtttgctgggagacagtggcttcactaacacctcaatatgctttgagaatgttactttttattactgatatgatgagttggctatgaatagatttgtaattctgacactaaggaataga

SEQ ID NO: 105869 - DNA, 201 bp, Bos taurus; identical to SEQ ID NO: 24791

SEQ ID NO: 105870 - DNA, 201 bp, Bos taurus; identical to SEQ ID NO: 24794

SEQ ID NO: 105871 - DNA, 201 bp, Bos taurus; identical to SEQ ID NO: 24795

SEQ ID NO: 105872 - DNA, 201 bp, Bos taurus; identical to SEQ ID NO: 24796

SEQ ID NO: 105873 - DNA, 201 bp, Bos taurus; identical to SEQ ID NO: 24807

SEQ ID NO: 105874 - DNA, 201 bp, Bos taurus; identical to SEQ ID NO: 24808

SEQ ID NO: 105875 - DNA, 201 bp, Bos taurus; identical to SEQ ID NO: 24809

SEQ ID NO: 105876 - DNA, 201 bp, Bos taurus; identical to SEQ ID NO: 24810

SEQ ID NO: 105877 - DNA, 201 bp, Bos taurus; identical to SEQ ID NO: 24811

SEQ ID NO: 105878 - DNA, 201 bp, Bos taurus; identical to SEQ ID NO: 24812

SEQ ID NO: 105879 - DNA, 201 bp, Bos taurus; identical to SEQ ID NO: 24813

SEQ ID NO: 105880 - DNA, 201 bp, Bos taurus; identical to SEQ ID NO: 24814

SEQ ID NO: 105881 - DNA, 201 bp, Bos taurus; identical to SEQ ID NO: 24815

SEQ ID NO: 105882 - DNA, 201 bp, Bos taurus; identical to SEQ ID NO: 24816

SEQ ID NO: 105883 - DNA, 201 bp, Bos taurus; identical to SEQ ID NO: 24817

SEQ ID NO: 105884 - DNA, 201 bp, Bos taurus; identical to SEQ ID NO: 24818

SEQ ID NO: 105885 - DNA, 201 bp, Bos taurus; identical to SEQ ID NO: 24819

SEQ ID NO: 105886 - DNA, 201 bp, Bos taurus; identical to SEQ ID NO: 24820

SEQ ID NO: 105887 - DNA, 201 bp, Bos taurus; identical to SEQ ID NO: 24822

SEQ ID NO: 105888 - DNA, 201 bp, Bos taurus
ggcagcgtgacccctcgaaaatacttctagggatgaaaacacaatccacacagatggcttgttagatagggagtgcttctgaatgttaactgcatcccactcccctccattagcaggggttggcagggggcagatggtggtagtggaagagcccaggccccaggcggccctcagccccatccacactccaagagtgggtag

SEQ ID NO: 105889 - DNA, 201 bp, Bos taurus; identical to SEQ ID NO: 24824

SEQ ID NO: 105890 - DNA, 201 bp, Bos taurus; identical to SEQ ID NO: 24825

SEQ ID NO: 105891 - DNA, 201 bp, Bos taurus; identical to SEQ ID NO: 24827

SEQ ID NO: 105892 - DNA, 201 bp, Bos taurus; identical to SEQ ID NO: 24828

SEQ ID NO: 105893 - DNA, 201 bp, Bos taurus
cacaaagagttggacacaactcagagactgaacaccacctctaatatagagtaggactcatatatcttaatgaaaggaagggcaaaggggaagaacacaagtgcctgggagtctgtggcaacggggagaatattagtagagtataactacccttgtgagctatatagtcactgagtagccctcaaagagctagatttgttt

SEQ ID NO: 105894 - DNA, 201 bp, Bos taurus
cataagtattttatttaacagctgttatgttagccatcagtggcattattaatcgatggctacatgtttgtttcttccttgggaggctttgtgggccccatggcagctagaaaccaaggggcctgaggacgagtcccgtatgcctcccgctgagccttgcttcatctttctgcagaccacaatcctctatctctgaagtga

SEQ ID NO: 105895 - DNA, 201 bp, Bos taurus; identical to SEQ ID NO: 24830

SEQ ID NO: 105896 - DNA, 201 bp, Bos taurus; identical to SEQ ID NO: 24833

SEQ ID NO: 105897 - DNA, 201 bp, Bos taurus
cattccctccggtagctccactcccaggcccagggagtggctggggcagagcaaacagattcgcgcgggctaggtctggagtcaggctgagccgggagatcgcgctccaggccagggctggggtcaagggaaggatggggtaccgagcactctccccaggcgaccctgtccgatgagctgtcagaggcagcagatagagag

SEQ ID NO: 105898 - DNA, 201 bp, Bos taurus; identical to SEQ ID NO: 24837

SEQ ID NO: 105899 - DNA, 201 bp, Bos taurus; identical to SEQ ID NO: 24838

SEQ ID NO: 105900 - DNA, 201 bp, Bos taurus
gtcctatttatgccaaacttggtccatggtgagccctcaggttctgctccttttctggtaggtcttcctccttgcttggccttcctgaagggagaaggtgttgtcccaggatcccttaagcccttgcccttcctcaagggatgctgctgtcttcagcctgggttttgccaccacctgctctacctcctgcaggccagagcc

SEQ ID NO: 105901 - DNA, 201 bp, Bos taurus
tttcaagaaaatatcctgaagctgaatgacgtaagtttcacaataaacaggcccattgagttcccagcacaattgataaaaatagtcactccaaggcatagaagggaaatttcagaaccccgtggccaaacaaaatactctaaaagttttcagagaagggtttaaaaaaaagattaccataatgcataaaatatgattgac

SEQ ID NO: 105902 - DNA, 201 bp, Bos taurus
gcccagaaacacagtcatgaaaactcagccatttgaaggctaaattttgagcaggagtgactgacagctctgagtgagtgaggcctgtgtagagctgtgcgggtcatgaactggagtacaaagcagaagtgggctggcaggacactcacaatcgggacaaggcaggcagcaggggacttgggtggtgcttaagtcgccagt

SEQ ID NO: 105903 - DNA, 201 bp, Bos taurus
agggaaggaggacattcacacaggccaatctcaccacctcttctcccagcccccacacacagcctccctctctaatggcatcaaagccacgacgggctgcccccactgacgagggccctaagcctcagtgtcagggacatgcagagcagggattcattatcttggaccctgcgctggttcccgagagaggctgtaacaaag

SEQ ID NO: 105904 - DNA, 201 bp, Bos taurus
gtctgatttctttcactcagaataattattttgagatttatccatgtttttaagattcacccatgttttcctatttgggcctgttacaaataatgctgcaatgaatattcatgtataagtctttacgggtaaatacctaggagtggaacggctggatcatatggtcggtatgtgtaactctttttaaaatggccaagtgtt

SEQ ID NO: 105905 - DNA, 201 bp, Bos taurus
aggcacagaggaagagctgaatcagcaatacctgatggcatgcaaaccaatcaacaccaggacttgaatccattcaacatctgagaactctgaagggccccaactggaaccatctccaatgggctacaggaacagagagcggggttctgggctcagagaccacatggaaactacaggccactcgatgtgccagcctgcagc

SEQ ID NO: 105906 - DNA, 201 bp, Bos taurus; identical to SEQ ID NO: 24839

SEQ ID NO: 105907 - DNA, 201 bp, Bos taurus; identical to SEQ ID NO: 24843

SEQ ID NO: 105908 - DNA, 201 bp, Bos taurus; identical to SEQ ID NO: 24844

SEQ ID NO: 105909 - DNA, 201 bp, Bos taurus; identical to SEQ ID NO: 24849

SEQ ID NO: 105910 - DNA, 201 bp, Bos taurus
tcttggagaagagttttggatgaaaaagaaaagaattgctttattactttgccaggcaaaaggggacatagtggactcatggcctcaaaactgtgtatccagaccaagggggattttttaaggagttttatggcactgtttcaagggtgaagttgttgataggaattaaaatgtgtgcagggcttgcattcctttaatctg

SEQ ID NO: 105911 - DNA, 201 bp, Bos taurus
cccttcctgtatgccaattttcacagaataggccagaaatgacaggtgctctcttatgctcagagaggtgtctgttccaaagctgggaagtctacaacagcgcagaggccctgcatctgaccatcagaaaaagtatggtacttccatgaccactgagactggagttgtgtggcaagaggtttgggacaaagtcatgcagac

SEQ ID NO: 105912 - DNA, 201 bp, Bos taurus
aaatagttctcaaaaacaagttaataacagtataacgaaataccatggggcagcaaacaaacagatctatgaaggtcatttcaactgcaaagagtacaagctggcacatgcagcactcaccagccgagacagtgaaattctaagaaaaatgaattaccatactaacatttattgagggtatactgcatatttactatgttc

SEQ ID NO: 105913 - DNA, 201 bp, Bos taurus
gtttctccaaagacatacagatggccaacaggcacctgaaaagatactcagcatggctaattgttagagaaacgcaaatcaaaactacaaggaggtaccacctgacaacagaagaatggccatcatttaaaactctacaaataatagatgctggagagagtgtgaagaaaagagaaccctcctaccttgttggtgggaatg

SEQ ID NO: 105914 - DNA, 201 bp, Bos taurus; identical to SEQ ID NO: 24852

SEQ ID NO: 105915 - DNA, 201 bp, Bos taurus; identical to SEQ ID NO: 24853

SEQ ID NO: 105916 - DNA, 201 bp, Bos taurus; identical to SEQ ID NO: 24854

SEQ ID NO: 105917 - DNA, 201 bp, Bos taurus; identical to SEQ ID NO: 24855

SEQ ID NO: 105918 - DNA, 201 bp, Bos taurus
ggccccctggcagcagtagctagtgatagaactacatacaagtgggactggagttgaactcaaaggggacaggggtgtttccagtatgcagtcagaaccatgacatcaggcctgacactggtgtgctggtttgcattcccataacagtcctccttaatcataagctctacctggattccaagctccctcaaagacattatt

SEQ ID NO: 105919 - DNA, 201 bp, Bos taurus
tatatatcaggacatagtgattatggaaaattctaatattttgatatgtcaaggtcaataacatatttcaatatttaggttaatttcacacagagtgcacctcataatttctatagagacattgaaggattattatgcagctactcccatcacaaatgaatccttctataagacaaccccaaattgctgcaaaagatgaaa

SEQ ID NO: 105920 - DNA, 201 bp, Bos taurus
gaaagaataactttctatggttcttactaccaattcaaagttactttattgtttcctgatcttttcctaggaagactcaagacctataggtccatgaacaggccatataatagcattctaggaaactaattttctatatatgtagcaggtataaatgagctgttcttccaaacctctcagataatacatggtactgacttg

SEQ ID NO: 105921 - DNA, 201 bp, Bos taurus; identical to SEQ ID NO: 24856

SEQ ID NO: 105922 - DNA, 201 bp, Bos taurus; identical to SEQ ID NO: 24859

SEQ ID NO: 105923 - DNA, 201 bp, Bos taurus; identical to SEQ ID NO: 24860

SEQ ID NO: 105924 - DNA, 201 bp, Bos taurus; identical to SEQ ID NO: 24864

SEQ ID NO: 105925 - DNA, 201 bp, Bos taurus; identical to SEQ ID NO: 24865

SEQ ID NO: 105926 - DNA, 201 bp, Bos taurus; identical to SEQ ID NO: 24866

SEQ ID NO: 105927 - DNA, 201 bp, Bos taurus
gggggccaaaggagcccaagtgactcactgactacaaggaagtgagtttggttcccagctcagtgtgaggatttcctccaaggcatcaccaccagagcaaaggccccaccccactcaggcctcctgcatgggagggcaaggcctggggttcgatactcacctgctgacttcttggacattgttggctcgagcagcttccat

SEQ ID NO: 105928 - DNA, 201 bp, Bos taurus; identical to SEQ ID NO: 24868

SEQ ID NO: 105929 - DNA, 201 bp, Bos taurus; identical to SEQ ID NO: 24869

SEQ ID NO: 105930 - DNA, 201 bp, Bos taurus
ggaccagggcccttgtcactgatcactggtctagtggctaggatctggtgcttttactgctgtaacatggtctcaatctctggctgggaatccaaatcccgttccaagcctttgtaggctgaggccacacaagattaacaggaaggctatttgtacatccagatgagaccttcgaagacacaggaggaaaaaaagcaaggt

SEQ ID NO: 105931 - DNA, 201 bp, Bos taurus; identical to SEQ ID NO: 24873

SEQ ID NO: 105932 - DNA, 201 bp, Bos taurus
aaagaatttcaatgagcagagattgggatgaagggcattttatgatgagggaatggtagaaacagaagccaaaatcaagaatgttcaagtagtattgtgactatagtctaaggcaaagcgaagcagggaataaacataaaaaggctatatgggcttcactaattagagttgtgactgtcatgtttttaggaagatatcgtt

SEQ ID NO: 105933 - DNA, 201 bp, Bos taurus
gctctgccctcaccaccattggtccggcccctccaggccccgccccgaagcgctcaccgatcgcgcagatcttgcgctcgcccagccaaactccggtgtagggtgggggccgcgcgcgggcgccgggtaggcccaggagctcgcacagtcgcaccgcgcacgcctccagcgcggccacgtgggcgcgcaggcgcaggccga

SEQ ID NO: 105934 - DNA, 201 bp, Bos taurus
tcaagtttacagttgaggaaattgtgttttgaccgggttaagtaacaagttgtttaatcttaccatcagttggtttcgttttcctcgaagtttgttattggttcaggcttgacctgcctcacagggttgaagtaaagatcaagtgagacgatggatgtgagagcgtttcgcgcatcgtgatgattgagtgcctactgtgag

SEQ ID NO: 105935 - DNA, 201 bp, Bos taurus; identical to SEQ ID NO: 24876

SEQ ID NO: 105936 - DNA, 201 bp, Bos taurus; identical to SEQ ID NO: 24877

SEQ ID NO: 105937 - DNA, 201 bp, Bos taurus
gatccaacttgtataataaaacttggccatctcccttttcacaagtatgggacacggacagaaaggaggaagagatccccttgccctgctaatcaatacacctgcttgggtatgaggcaaacttcaggatatccaaagagggtgtgaagtactgcagggcctctcacaagctctcttcccctccccctgccacgcctcagc

SEQ ID NO: 105938 - DNA, 201 bp, Bos taurus; identical to SEQ ID NO: 24878

SEQ ID NO: 105939 - DNA, 201 bp, Bos taurus
tccctgctgccggcccatcaacactgtgggtaagccaagaacccaggctgggaggggttgggttacagggcaaaagacttgggcttgggctgaaggggaatggaaatgggccagacacatccttgtcctcctggaattcaggttctatactgggaaatggacatactagcaagtaacccagatgcaaggcatctgagatga

SEQ ID NO: 105940 - DNA, 201 bp, Bos taurus
gcagccaaataatcataaacaaattctttaaaaaataaataagaagcaggttggtaaagacgatgtagatagggaagatgggcagggtgtggaaaaagaggagctggggggaagacacttcggctccagagcacagtgtgagcaaagacccagaggtggaaaagtacattcaaggacacagcaagtgacctgatgtaacca

SEQ ID NO: 105941 - DNA, 201 bp, Bos taurus; identical to SEQ ID NO: 24879

SEQ ID NO: 105942 - DNA, 201 bp, Bos taurus; identical to SEQ ID NO: 24880

SEQ ID NO: 105943 - DNA, 201 bp, Bos taurus
agctgccagaagaaaaagaaatagactaatctgctttaaaaatttttttaattatttggattgaatttagtaaattagtttatggacagtgtgtttatggacagtgttctttttcgggaaagattctgttaaagagatatttcaaagaatagaaattccaacccaaatagacagatttaagatactagaataattttgggg

SEQ ID NO: 105944 - DNA, 201 bp, Bos taurus; identical to SEQ ID NO: 24881

SEQ ID NO: 105945 - DNA, 201 bp, Bos taurus; identical to SEQ ID NO: 24882

SEQ ID NO: 105946 - DNA, 201 bp, Bos taurus
ctagccccgtccccctccctcctccaccctccccgcatcaggtcgctctgccaagttactgagctcccctgctgctcctccagtttgctgctcctgctgcagggccagtgaggaaagtggtgagagaccctgggcccagcaacacccctcttcaccccgctaagactgagggaacccactgggctactgtccccaggcaga

SEQ ID NO: 105947 - DNA, 201 bp, Bos taurus; identical to SEQ ID NO: 24883

SEQ ID NO: 105948 - DNA, 201 bp, Bos taurus; identical to SEQ ID NO: 24884

SEQ ID NO: 105949 - DNA, 201 bp, Bos taurus; identical to SEQ ID NO: 24885

SEQ ID NO: 105950 - DNA, 201 bp, Bos taurus; identical to SEQ ID NO: 24886

SEQ ID NO: 105951 - DNA, 201 bp, Bos taurus; identical to SEQ ID NO: 24887

SEQ ID NO: 105952 - DNA, 201 bp, Bos taurus; identical to SEQ ID NO: 24888

SEQ ID NO: 105953 - DNA, 201 bp, Bos taurus; identical to SEQ ID NO: 24889

SEQ ID NO: 105954 - DNA, 201 bp, Bos taurus; identical to SEQ ID NO: 24891

SEQ ID NO: 105955 - DNA, 201 bp, Bos taurus; identical to SEQ ID NO: 24892

SEQ ID NO: 105956 - DNA, 201 bp, Bos taurus; identical to SEQ ID NO: 24893

SEQ ID NO: 105957 - DNA, 201 bp, Bos taurus; identical to SEQ ID NO: 24895

SEQ ID NO: 105958 - DNA, 201 bp, Bos taurus; identical to SEQ ID NO: 24896

SEQ ID NO: 105959 - DNA, 201 bp, Bos taurus
ctttaagcctggccccctttctctgctcccaactgttcacaggtccctcaccctacagtcattcccctggtgaaacagaacacggcagacaccccagttgatgctcctcaggccctgagcccagtgtgtctttcccaccacaaatccatcctccacctgaagtcttccattagctcaatcagaacaaggtatccctcctct

SEQ ID NO: 105960 - DNA, 201 bp, Bos taurus; identical to SEQ ID NO: 24897

SEQ ID NO: 105961 - DNA, 201 bp, Bos taurus; identical to SEQ ID NO: 24898

SEQ ID NO: 105962 - DNA, 201 bp, Bos taurus
tacttcaaatgagtaaggaaataatatgctatttcagggctattagctatatagtttttaaaaaataaagttagatctcttcttcatattatactaaaacttcaacttcttgtgtatcaaatacttagatgaagaaagaaaaccagaaaaacacagctgattatagctataatcttggagtaagaaaagccttcctaaact

SEQ ID NO: 105963 - DNA, 201 bp, Bos taurus
tttcccatagtgagaaacctgactttcattgttcttgatatatttatttatttgcttaatctctctgcatgtagctgatttcctgatactgctaggcccctaccccctctttgcaaatagacctgccctttgctgaggttggtgtcctctgcgtagcacgcagcttactttgttaggcctgactcatggctatttgatagt

SEQ ID NO: 105964 - DNA, 201 bp, Bos taurus; identical to SEQ ID NO: 24900

SEQ ID NO: 105965 - DNA, 201 bp, Bos taurus; identical to SEQ ID NO: 24902

SEQ ID NO: 105966 - DNA, 201 bp, Bos taurus; identical to SEQ ID NO: 24905

SEQ ID NO: 105967 - DNA, 201 bp, Bos taurus; identical to SEQ ID NO: 24909

SEQ ID NO: 105968 - DNA, 201 bp, Bos taurus
aagcttatcttcccctagtatgaatacaaatgatgactcttttctcagctgtgtatgactttcttttaaaccacttcacacggataagaagcagacatcacccactttatccaatcaaggaaaattatatgtaagttttgatttggaaatgaacagacaacctaagtggccaaaactatgaaaaatatacaactacttctc

SEQ ID NO: 105969 - DNA, 201 bp, Bos taurus; identical to SEQ ID NO: 24910

SEQ ID NO: 105970 - DNA, 201 bp, Bos taurus; identical to SEQ ID NO: 24911

SEQ ID NO: 105971 - DNA, 201 bp, Bos taurus; identical to SEQ ID NO: 24912

SEQ ID NO: 105972 - DNA, 201 bp, Bos taurus; identical to SEQ ID NO: 24913

SEQ ID NO: 105973 - DNA, 201 bp, Bos taurus; identical to SEQ ID NO: 24914

SEQ ID NO: 105974 - DNA, 201 bp, Bos taurus; identical to SEQ ID NO: 24915

SEQ ID NO: 105975 - DNA, 201 bp, Bos taurus
aaggcacatacttgaagtctaccagtacatcagagtaatttccctcataataacatatttacattttaatccttgaaacaaccctttgaaaggtgtgactgttgttcccgttataaagacaaggaagccaaaatagggagggtaaagcaactcgttcctccagcttgttgcctacttcataaagcttagatatgctgccta

SEQ ID NO: 105976 - DNA, 201 bp, Bos taurus; identical to SEQ ID NO: 24918

SEQ ID NO: 105977 - DNA, 201 bp, Bos taurus; identical to SEQ ID NO: 24919

SEQ ID NO: 105978 - DNA, 201 bp, Bos taurus; identical to SEQ ID NO: 24920

SEQ ID NO: 105979 - DNA, 201 bp, Bos taurus
tcccggtgtttctgttgctgtctttttgatgtcacaaagcgaagttgataaacacattcaagtcacaattaaaaaacattttcactgaccagttgccaccaacgatatcatcagacagcttcgttgctgctgtaacaatgcgtttaatggtgttgatgtgcaggcgagaaggtgcttccctttatctggtccttacctcgc

SEQ ID NO: 105980 - DNA, 201 bp, Bos taurus
atatgactgcagagatgagtggtaccatccttaggcctgggcctattctggccctccacagtctgcatgtctccatggggcagggcctatgtggggccaaggagccatgccctcccttctagaatctagaatctgcatcatgctgtgtatacccaaaccctggaattccctgtccacatctgcctccatggcctatgtggg

SEQ ID NO: 105981 - DNA, 201 bp, Bos taurus
atatacaaaaaatgaaaagttaacaacgaccaagaaaaagaggttgttttcattactctagaaggtatccctggggtcttcagggagcatatttccccaagggtgatctcaaacctttccctaaagaacccccaggcataagagccccagtgcatctccagcccaggatctggaggcatacacccaggcatgaaatgtctt

SEQ ID NO: 105982 - DNA, 201 bp, Bos taurus; identical to SEQ ID NO: 24924

SEQ ID NO: 105983 - DNA, 201 bp, Bos taurus; identical to SEQ ID NO: 24925

SEQ ID NO: 105984 - DNA, 201 bp, Bos taurus; identical to SEQ ID NO: 24926

SEQ ID NO: 105985 - DNA, 201 bp, Bos taurus; identical to SEQ ID NO: 24927

SEQ ID NO: 105986 - DNA, 201 bp, Bos taurus
ttacaatttttttttcaattcttaggtgtgggcagaagaaaaaactggtgatcaacaatgggaatggaaccatggaggagagaaagcccagcggactcaacggagaagctagcaagtctcaggagatggtgcatttggtgaacaaggggtcgtcagagacccaagaccagttcatgacggcagatgagacgcggaacttgc

SEQ ID NO: 105987 - DNA, 201 bp, Bos taurus; identical to SEQ ID NO: 24931

SEQ ID NO: 105988 - DNA, 201 bp, Bos taurus; identical to SEQ ID NO: 24932

SEQ ID NO: 105989 - DNA, 201 bp, Bos taurus
ctcaccaaattttagctgtcagtatcaggcagcgccctccccgcccccactaaaagtgctgtgtcaaaacagcaattgtgattgcacaagtaataataacgccaaagctaacatacagagcacatgtggccagaacctcaagccagctccttgaagctggttgtgtgctagctaaccaaaatcttggcagtcggcgagtca

SEQ ID NO: 105990 - DNA, 201 bp, Bos taurus; identical to SEQ ID NO: 24933

SEQ ID NO: 105991 - DNA, 201 bp, Bos taurus
ttggaaggtggaacagatgtctccagtttagaaaggatatctaataaagtctgaaacattggatggcacttctcagtcctcaaactccctcatgaagacacgatccttaggtcttcactttcttgaggaagggggagaaggcactcattaaatattttctgggaccagttagcagtagcaaagtagggagttccatgtcag

SEQ ID NO: 105992 - DNA, 201 bp, Bos taurus
gtttgcacatctgtcgttggaaatatttgccaagaaaacttcacgaagagtcttttacgaggaaaccaaggaaaccaagcaacccacatggtttgtctgcctcccctctgtatccctttctcataggattttatgagcctttaattgttatactgagagtcatcagggcttggtggataaaagggtgagttttggggtccg

SEQ ID NO: 105993 - DNA, 201 bp, Bos taurus; identical to SEQ ID NO: 24934

SEQ ID NO: 105994 - DNA, 201 bp, Bos taurus; identical to SEQ ID NO: 24937

SEQ ID NO: 105995 - DNA, 201 bp, Bos taurus; identical to SEQ ID NO: 24939

SEQ ID NO: 105996 - DNA, 201 bp, Bos taurus; identical to SEQ ID NO: 24942

SEQ ID NO: 105997 - DNA, 201 bp, Bos taurus; identical to SEQ ID NO: 24943

SEQ ID NO: 105998 - DNA, 201 bp, Bos taurus
gaaggaatgccttttttaaggcagtggtctccaacacttttggcaccggagaccagttttgtagaagacaatttttccatggacagagtgggggatgatgatttggagatgattctcataaagagaaagcaacctagatcccttcatgtgtagttcacagagggcttgtgtttctattgttaccaagttcaagatttttcc

SEQ ID NO: 105999 - DNA, 201 bp, Bos taurus; identical to SEQ ID NO: 24944

SEQ ID NO: 106000 - DNA, 201 bp, Bos taurus
actcttttcatagctatttgtaaggcctcctccgctctggtatagggtgcccatgacataaactttatgtataatgtgtattagcccaaagtttctcatacggaaaactttctttaagatactgaaagatgatagaaatcagaagtcattttatttatgcaagttcatttcatgataccatttgttgatgaatattcttgc

SEQ ID NO: 106001 - DNA, 201 bp, Bos taurus
aagctcattttatccctctaatagttttctaaaaatttgtaaccctgaaaatgtttcaacaattaactttgcttcaaaatgtaaaagcctagagggataagtggtttttccaggtgttgctattagaataaaaatatatcaagtatgtaaaggacatatgttcacacgtttaaattatttattttgtgaaagtttaatata

SEQ ID NO: 106002 - DNA, 201 bp, Bos taurus; identical to SEQ ID NO: 24945

SEQ ID NO: 106003 - DNA, 201 bp, Bos taurus; identical to SEQ ID NO: 24946

SEQ ID NO: 106004 - DNA, 201 bp, Bos taurus; identical to SEQ ID NO: 24947

SEQ ID NO: 106005 - DNA, 201 bp, Bos taurus; identical to SEQ ID NO: 24948

SEQ ID NO: 106006 - DNA, 201 bp, Bos taurus
tcacatctgttgatgctaattcaggaatgactcattcatctgcccagttctctcattgtattatgttactaagaccattctcaagttcctcagctgacttctgcactcatctttcttcttatccataccatcccctctctagtacctgttagtttccgaaaaatagactggtgagaaagtttaaaagaaacagtaaagaaa

SEQ ID NO: 106007 - DNA, 201 bp, Bos taurus; identical to SEQ ID NO: 24949

SEQ ID NO: 106008 - DNA, 201 bp, Bos taurus; identical to SEQ ID NO: 24950

SEQ ID NO: 106009 - DNA, 201 bp, Bos taurus
aatcttaggggcctgtactgtaactttcctaccggggcttggcagagacaccacatggcatctttgttcagtacaaatacctcagtgacatgagatcagccgagccatatggctcaagtggcaaagcaacagcctggatctgtgacaaaggattttcttgctctgagcctcactcaagataagtagcccttgacatcaccc

SEQ ID NO: 106010 - DNA, 201 bp, Bos taurus
cgcactgctttagaaccaccgcagggcctatggcagaggttctgtaatgttctctctgacactacagttcaggagactgagatggcacagctgaaaagtcacatggccaggatttgaacctaagcactgagcttctctggtggctcagacggtaaagaatctgcctgcaatgcagcagacccaggttcaattcctgggtcg

SEQ ID NO: 106011 - DNA, 201 bp, Bos taurus
cttgcattcccactgtctgtctcaatatgcacccatgggatgtggtctgggagcccagtagcctcgctggactgaagtttagctgggcgactggcccacgggtactcaacagagaactcatagtaggcacctgagtcctgccatgaaagccagtctctaagaaagggggaactgttccacctgtagcagccttgcctggcg

SEQ ID NO: 106012 - DNA, 201 bp, Bos taurus; identical to SEQ ID NO: 24954

SEQ ID NO: 106013 - DNA, 201 bp, Bos taurus; identical to SEQ ID NO: 24956

SEQ ID NO: 106014 - DNA, 201 bp, Bos taurus
ccatctcttatctatcaaaaaaaaaaaaaagaaaagttcattcaggtttttccataagaaggtatggcaaaacccaattgaaatttttggccaacccaatatataaagtctataaaataaactgctgtctgtagaagtggcaagcagctcggcgattcccccttgtttgtgtgggcaagttctctccactctcagtggcct

SEQ ID NO: 106015 - DNA, 201 bp, Bos taurus
agttggccagtgattacgattgtttgagccccaaagaaaccttcaaggaggccaaactatttaataccttcttcagatgtagccacagaagattggggaagagagaattttccagaactggactggccagattagcttcctctgccagagcaagtcttgactgttcaggccagtaggatttacctacctcgaaggcagtgg

SEQ ID NO: 106016 - DNA, 201 bp, Bos taurus
atgcccacatctggacgccgactcttcggggccggctgagcgtccacctgcccctctgggcgccatgaccggtgccccttctccaccccctgccctttcttatcgctttctcctttatccccagaggaatttggcgtattgagttacttcatatttcttctgaactctccttttctctagctttaaagattaagtattttt

SEQ ID NO: 106017 - DNA, 201 bp, Bos taurus
aactgtgctcaagagttgttgggaatccaaggagggttttctttacggtacttggagccacctgtctcatcctgccgtgggccctacagcaggccccaccgcaccctgtggtctcacctagggcaccaagaagctgggttcttacagcccgcacggatgaaaacaaggcctccctgaaggagagcccagatgcagataaca

SEQ ID NO: 106018 - DNA, 201 bp, Bos taurus; identical to SEQ ID NO: 24959

SEQ ID NO: 106019 - DNA, 201 bp, Bos taurus
cttgcatcagagctggcgcaggaggccctgccagcacacagcagcctcttttccagatggtccttgcaggctcagctcccacaaatgagacaaccgggggtgaatggcacaggcctggtgatccagctccaaccttcttcttgtccaaaagggccccacctgccacctgcgcccaggctccctcttggcccactccatgcc

SEQ ID NO: 106020 - DNA, 201 bp, Bos taurus
gagagtcagaagcagacatgactgtgttcccctgggctactcctaggtaggtgggcccttgctgacccaacaggcagtgataatcgaggaaaggccaaggatttggctagtatctcccatccctctgctagccttccccagtgtctgtcctagtttctgaaaccagaatgttctggatcacctttgcccaaggccttcctt

SEQ ID NO: 106021 - DNA, 201 bp, Bos taurus
taggagctcaggtctttaagacaaagaccaaatatgtttattactataccacacctctccactgcttgctgtgctagcttcatcctagggggaattcctgctggggtcttctgcaggatgtgcctgccatttgcaataatggcttcgtgctttctccagagggtaggacagtcattcccatgagggaggtgcagcatctga

SEQ ID NO: 106022 - DNA, 201 bp, Bos taurus; identical to SEQ ID NO: 24960

SEQ ID NO: 106023 - DNA, 201 bp, Bos taurus
tcatggggtcgcaaagagtcggacaggactgagcgactgaactgaactgaagtgctaaacaaacaagatgtttattatcatcaatgttatcatgacacctcatatgaatcaataggcctggaagggatcctaatcaggatgaggaattgatgctgtgagtaaaacaccaccaatgaaaataacaaaatgcgaatctctggg

SEQ ID NO: 106024 - DNA, 201 bp, Bos taurus
tatatatctaagaataagtggaagggcttaccattgagactttaggaagaagaacagagaggttcagggacttgccccaggccacacagtgacctcaggttcaaaggctctttaatcacgcggtcaaggatcagtgatcttagtggcttagtcaacaagatgtactgagcactacaggtgtccaggccctgacctgggaac

SEQ ID NO: 106025 - DNA, 201 bp, Bos taurus
gcagccagcccctcccggcctccaacctctgcgctccgaggcccgggacacagtcagccacagcgcctcccatatgagtaacagcgctttaattaggatactataggaagtggggcccacggcggcttctggcgagaagtgccagcagcaattccggagccgcacgaagatggatggatcgtgtattacaccctgcaccgc

SEQ ID NO: 106026 - DNA, 201 bp, Bos taurus; identical to SEQ ID NO: 24961

SEQ ID NO: 106027 - DNA, 201 bp, Bos taurus
gaattggcaggacacagccctccaagcagcggcatgagaggggcccttagtaccaggacaagaccacgaagttactccttaggatctaagccatcaaggcactacacacagccgaggtggggccgggtcagccctgcctacgtggcgctctgaccaccatttcctggctggaaacaggtgcctctgtgtcagcaggaaaca

SEQ ID NO: 106028 - DNA, 201 bp, Bos taurus
ctctggggacctcaaacagccaggaaaggccagtctggtctcttgaagcagaaaggagccaagccctaagaaagcctgggattccatctggtaaacccttacccctactccccaggcccccaccccctcacctgcctcctggccagctcctgccccctgcctctcactcctcacacgcccccacttcctcttgctcatgag

SEQ ID NO: 106029 - DNA, 201 bp, Bos taurus; identical to SEQ ID NO: 24962

SEQ ID NO: 106030 - DNA, 201 bp, Bos taurus; identical to SEQ ID NO: 24963

SEQ ID NO: 106031 - DNA, 201 bp, Bos taurus; identical to SEQ ID NO: 24964

SEQ ID NO: 106032 - DNA, 201 bp, Bos taurus; identical to SEQ ID NO: 24965

SEQ ID NO: 106033 - DNA, 201 bp, Bos taurus; identical to SEQ ID NO: 24966

SEQ ID NO: 106034 - DNA, 201 bp, Bos taurus
agcgctggctgaacccctgaccagtgtgcacacactggcagtgccctccgtgaggagcagggtcttaggaggacaggtgagcctgcagaaatgtcctcccaaggcctgaactgggagtggggcccctttctcagcactcctgcaggaaaagaggggaaggccgtgaggagtcgagccacagcagagacgtctggtggagcc

SEQ ID NO: 106035 - DNA, 201 bp, Bos taurus
acacgtccaatcgccatctcgtgaggcacaggccaggtgcaccaatggtgccggtgcgtaggggtgtgtgtccacgcacgtgcagggcacacacggcacataagacttcagagcgacgtcgtttcccagaacgaatgcggagtgcctcctgggtgccaggcacagtgaaggctggggatgccgcagtgacaaggccaataa

SEQ ID NO: 106036 - DNA, 201 bp, Bos taurus; identical to SEQ ID NO: 24967

SEQ ID NO: 106037 - DNA, 201 bp, Bos taurus
cttgagctgtgagggaagccttgaagagcgccttgtagacgtgagtgcgacgactcgcgcagtcttgggaacgaaactcccggggcctgcgagccacgagacttccgaggtgtgaggtattatctgcgacccgtgctgtcactgcagctccggagcgcagagccctcaggcaggaggcgcagctggccggccccaggcccc

SEQ ID NO: 106038 - DNA, 201 bp, Bos taurus; identical to SEQ ID NO: 24969

SEQ ID NO: 106039 - DNA, 201 bp, Bos taurus
ctggcctggggcagaatcaagtctcccagtttgacgcttctccaaatggaggagattcagggctccctgactcccagggacagtggggcaggaaggaggggtataacaacagggggccgaaaaggactaagagcttcagatgtgaacgtggctctccggtggctctgatcgtcttggttattaacagtccttggggtgacc

SEQ ID NO: 106040 - DNA, 201 bp, Bos taurus; identical to SEQ ID NO: 24970

SEQ ID NO: 106041 - DNA, 201 bp, Bos taurus
ccctgggtgatggtggggaattccagggtggctttggacgggaagtgatctttgaatccagtcttgaagtcctctagtaggtacaagggaataattctcagtggctgtgataaaaaggacagtgaattttttaccgggccacattgcccgatgatggtgggaacaatacaacttgactgtgtaatactttggttttggact

SEQ ID NO: 106042 - DNA, 201 bp, Bos taurus; identical to SEQ ID NO: 24971

SEQ ID NO: 106043 - DNA, 201 bp, Bos taurus; identical to SEQ ID NO: 24972

SEQ ID NO: 106044 - DNA, 201 bp, Bos taurus; identical to SEQ ID NO: 24973

SEQ ID NO: 106045 - DNA, 201 bp, Bos taurus; identical to SEQ ID NO: 24974

SEQ ID NO: 106046 - DNA, 201 bp, Bos taurus; identical to SEQ ID NO: 24975

SEQ ID NO: 106047 - DNA, 201 bp, Bos taurus; identical to SEQ ID NO: 24976

SEQ ID NO: 106048 - DNA, 201 bp, Bos taurus; identical to SEQ ID NO: 24977

SEQ ID NO: 106049 - DNA, 201 bp, Bos taurus; identical to SEQ ID NO: 24978

SEQ ID NO: 106050 - DNA, 201 bp, Bos taurus; identical to SEQ ID NO: 24979

SEQ ID NO: 106051 - DNA, 201 bp, Bos taurus; identical to SEQ ID NO: 24980

SEQ ID NO: 106052 - DNA, 201 bp, Bos taurus
gcataacgctagtgatgagcatacatggggcctgaatctattttctatgtgattagttaccagagtgtaaagtgtacatacaggccttgagtatatttcacgttttatgtacaacaaaatgatataaaagctaagagagtgcaaatacccaaatgggacgggcctggcagagctgctgggaaacgtgcccacactcggtct

SEQ ID NO: 106053 - DNA, 201 bp, Bos taurus
taatattcagaatatacaaaaaactggcctaactcagtaacaaacaatgcaattaaaaatgggcaaaaggcttgaatacacagttcttcaatgaagacacctgcatggccaacaggcatgttaaaagatgctcaacatcactaatcataaggtttacaaaatcaaaatgaaatgttacctcacacccattaggatggccac

SEQ ID NO: 106054 - DNA, 201 bp, Bos taurus; identical to SEQ ID NO: 24982

SEQ ID NO: 106055 - DNA, 201 bp, Bos taurus; identical to SEQ ID NO: 24983

SEQ ID NO: 106056 - DNA, 201 bp, Bos taurus; identical to SEQ ID NO: 24985

SEQ ID NO: 106057 - DNA, 201 bp, Bos taurus
tggtgcgctccttttttgggccgtcaccttgcatttcttcagcagctgacagtttctccagtttttcaaagtaattctaccacacgagaagacggtttcatttgcagcaagcgcagcacacggccgctctttaccatgaagcggcttataccagtggcagcgatgctgctcgtgctctatatgtactggcttttaactttt

SEQ ID NO: 106058 - DNA, 201 bp, Bos taurus
ggcagtgttccttgggaggtgggcagatgggtgggccttggtttccacgatcaggtctgagtctaccctcaagcctttaaatagcagttaaccttgggccggttcctgaacccagctgggctttaatccctgctctggaaatcaggaacagcagaacttacctttcaagcctggcccgaggatcccttgagatcacgtgag

SEQ ID NO: 106059 - DNA, 201 bp, Bos taurus; identical to SEQ ID NO: 24986

SEQ ID NO: 106060 - DNA, 201 bp, Bos taurus; identical to SEQ ID NO: 24987

SEQ ID NO: 106061 - DNA, 201 bp, Bos taurus
tctttggggccagcctctcaccctctgttcttggcctcatggaggagagtgggctggaaatgtctctcagagtgtctgggcctatcattgtgggaaaagatccctcaaagggatactttatacatgggcattcggcaaagccaggacaaatgccctggcatcaggccccaggatggcgtgagctgggatcctagaagccag

SEQ ID NO: 106062 - DNA, 201 bp, Bos taurus
aggagcctggaagagcctgagtcaacactatcgctgacattgcttctatggctaaagatggcccagccttcaaaacatgactccaatccttttctcctcaactctcttctcctttcttatttcatctcccatgcccttctctccctctcttcttcaccattttcactttatttattttcctttcttctttttgttgctatt

SEQ ID NO: 106063 - DNA, 201 bp, Bos taurus
cactaggctacaggggtgggcagggctctccctggttccttcagtgatgtcttcgaagggctgcccaccccgcttgcctgcggtggggccccacatggtgcttcagtgcctcgacgctattgcttcccctttgtctggggcagtcatctctctgactagctctcagcacagccccaggggtgatgaggccttagaccatga

SEQ ID NO: 106064 - DNA, 201 bp, Bos taurus; identical to SEQ ID NO: 24988

SEQ ID NO: 106065 - DNA, 201 bp, Bos taurus; identical to SEQ ID NO: 24989

SEQ ID NO: 106066 - DNA, 201 bp, Bos taurus; identical to SEQ ID NO: 24990

SEQ ID NO: 106067 - DNA, 201 bp, Bos taurus; identical to SEQ ID NO: 24991

SEQ ID NO: 106068 - DNA, 201 bp, Bos taurus
gccttgggggagaagttgagagggcttacaaaggcttctgtcttttcctgtgctttctgttgattcttaatgatggaaaagtcagaatggaacagagcaccggcctggagagggccagtgactaccttgggtggaaggaaggaggagtgactggcagaggatgtctgggacctggcaattccttgactacttagtggttat

SEQ ID NO: 106069 - DNA, 201 bp, Bos taurus
accagatgtgtaaccttggacgagtcactgatcctcaatttcctcaacttaaatgaagataataagtacctctcaagtttgccatgagattacctcacaccggttagaatggccatcattgaaaaatctacaaacaataaatgctggagagggtgtggagaaaagggaaccctcttgcactactggggagaaggatatggc

SEQ ID NO: 106070 - DNA, 201 bp, Bos taurus; identical to SEQ ID NO: 24992

SEQ ID NO: 106071 - DNA, 201 bp, Bos taurus
ttcatactgacccatcattagcctcttccacactgctgagcacttggagtataacctcagttctctgtgtaatggcattcttggtctcttgcatgataagatgttccacatctgtcatgcatatttcttgttctagatctagaatcatccacttttcaaaggagttctgcttcattttagtgagaaatggtatttagagag

SEQ ID NO: 106072 - DNA, 201 bp, Bos taurus
ggccctcatggcagcgcttgagctttcctttttcaagtcccaccgatcactcctcaaagaaacagaaacaaaaactagtttctactctgatggaaacagatggcccacttcttacgcagatgtgctttcaggccctaaacacttgccatgaataaaaacggaatcaaagatatgataaagatacatccttagatcataaaa

SEQ ID NO: 106073 - DNA, 201 bp, Bos taurus
gtgcgagtttggctctgggaagtgctttggagcttctccatccagccactgagctggtcatcgtcagttgtataaaatccaccttttgttgctcatcccagtatgatcgagaaatggttcgttgttgcatagtatgagagaaaacaacacttcagaacagtgatatttttgatttttggtcagatcacgaggcttccactc

SEQ ID NO: 106074 - DNA, 201 bp, Bos taurus; identical to SEQ ID NO: 24993

SEQ ID NO: 106075 - DNA, 201 bp, Bos taurus
ctaaggccttaaggcaggatcatgcatggcctgttaaggaatagctgtgtgattggaaagggtgaatgggagttgttaggggaaaaggccagggatgtgacagggaccatatcatccagggcaattagctgctgtaaggattggtctttactcttgttatagccacacattctgggaaacaagctcactcagaaggacaat

SEQ ID NO: 106076 - DNA, 201 bp, Bos taurus; identical to SEQ ID NO: 24994

SEQ ID NO: 106077 - DNA, 201 bp, Bos taurus; identical to SEQ ID NO: 24995

SEQ ID NO: 106078 - DNA, 201 bp, Bos taurus
ctcatttcagaaatgttaaaatatgtataggggaagaagggagatgcatattatgatgaagagaaaatggtaatcaggagacagtcaaaccaatggcctaattaaattcatcagtaaatgcagtcagcatgatttattgacctgttctgtgatagagaacctttttaggtgagaggtttttgtgtgttgatggacacactg

SEQ ID NO: 106079 - DNA, 201 bp, Bos taurus
ctgggtgtctcctgggacatggggctcagctggtgtccagtgcaaggcaggccctggatcccttgatgggcgatggcgagcagctcaaacagctctggcctagaacgccattgaccattgctaccctctcccagctctggcagcatttaaagtcctggtctcaccagccctgggacttggtgaccaggcctgggaagggcc

SEQ ID NO: 106080 - DNA, 201 bp, Bos taurus; identical to SEQ ID NO: 24996

SEQ ID NO: 106081 - DNA, 201 bp, Bos taurus; identical to SEQ ID NO: 24997

SEQ ID NO: 106082 - DNA, 201 bp, Bos taurus; identical to SEQ ID NO: 24999

SEQ ID NO: 106083 - DNA, 201 bp, Bos taurus; identical to SEQ ID NO: 25000

SEQ ID NO: 106084 - DNA, 201 bp, Bos taurus; identical to SEQ ID NO: 25001

SEQ ID NO: 106085 - DNA, 201 bp, Bos taurus; identical to SEQ ID NO: 25002

SEQ ID NO: 106086 - DNA, 201 bp, Bos taurus
aggcggcttctccaccacactttcttccccttccacagctgaccagagtcagtgagactcctcacacctcatttgccagttgctccactgccgtcatcaacggcccacttccaaacatgttcggcattggtgtctgctccagtctggaagagaaagggagctttcaagactcacccaactcagcagtccaaggagaagacg

SEQ ID NO: 106087 - DNA, 201 bp, Bos taurus
cactatgaccatcccacagatgaggaaaatgagactcagagaggtgacatgactgtcctaagatcacacaagtttctcttgagtacctgagaccaggccacgggaccctcaagctcagattctttcacgatgtcatccttcatgctgttatgcccaccgaccttcctcggccttcccaggacaggcctttgcccttttctg

SEQ ID NO: 106088 - DNA, 201 bp, Bos taurus
ctaaatagcattctttaagagtgatgatgttaggtatactttgctcatttaactagaaaagtaaagagcggatagagttaggttcctttggaggaagtgtctagaatttattacatcagaacttattatgtcagaaagaggggacttaagctaagtatgatgactaaattgggcacgtgttgctcccatttttctccttgc

SEQ ID NO: 106089 - DNA, 201 bp, Bos taurus; identical to SEQ ID NO: 25003

SEQ ID NO: 106090 - DNA, 201 bp, Bos taurus; identical to SEQ ID NO: 25004

SEQ ID NO: 106091 - DNA, 201 bp, Bos taurus; identical to SEQ ID NO: 25005

SEQ ID NO: 106092 - DNA, 201 bp, Bos taurus; identical to SEQ ID NO: 25006

SEQ ID NO: 106093 - DNA, 201 bp, Bos taurus
aggtctcagggtcccacctggccagactcaacgcttctctgacagagaagtcagagctggagaaaccctgaccggctgtgcagctgggcccacagagatctggggaaacgtgactcgtgtgggaaagactccgaggtgagacagcaaagcgctgggcacctccctgaccaaagccagggtgtctccctccccccaagaggc

SEQ ID NO: 106094 - DNA, 201 bp, Bos taurus
tttgaacagcagatttagcatttttttccctttttttcttcttagcaccttcttacatttttctctttttcatggtgtttggtttttttgctctttttcttccatctattttcaaagaatcttatttcagagatactcagtaagtagaattttcctctgtgtgttactattccttgcagaaaaaggtgacgtaaaataaag

SEQ ID NO: 106095 - DNA, 201 bp, Bos taurus; identical to SEQ ID NO: 25007

SEQ ID NO: 106096 - DNA, 201 bp, Bos taurus; identical to SEQ ID NO: 25008

SEQ ID NO: 106097 - DNA, 201 bp, Bos taurus; identical to SEQ ID NO: 25009

SEQ ID NO: 106098 - DNA, 201 bp, Bos taurus; identical to SEQ ID NO: 25010

SEQ ID NO: 106099 - DNA, 201 bp, Bos taurus; identical to SEQ ID NO: 25011

SEQ ID NO: 106100 - DNA, 201 bp, Bos taurus; identical to SEQ ID NO: 25012

SEQ ID NO: 106101 - DNA, 201 bp, Bos taurus; identical to SEQ ID NO: 25013

SEQ ID NO: 106102 - DNA, 201 bp, Bos taurus; identical to SEQ ID NO: 25014

SEQ ID NO: 106103 - DNA, 201 bp, Bos taurus
tctcactgcggtgacttttcttgttgtgtgtcacaggctctaggtcatggcctcagtagttgtggtatgtgggctcagtagctgtggcttgtgagttgctacatggcatgtggaatcttcctgggccaaggatctaacccatgtactctgcatcaacagatagattcttatccactgtactacaaaggaagtccgccaaat

SEQ ID NO: 106104 - DNA, 201 bp, Bos taurus
atagacttactaaaagattgatatgtattatttcaagtgttggaattaagatgtctcctggacaccttggattaattagagaacattccagtttagctttcaaaggggtctatgtctgtgagggagttatagacccagactgccaaggagaaatatgggtaattttacaaaaggaaaaaaaaggatgatctatttatcaat

SEQ ID NO: 106105 - DNA, 201 bp, Bos taurus
tggtggctgccagcccactcatatgcaggatgaagtattgatagagctggcttcagggcctaagtgtacttgagctggtgatatcacacccaagagcaagatgagataccagtgtagcagctgtggagcccagtggagtctggggttggtgctgtcatgctgctgagttgttaagcctctggtgctagtaagctatgtatg

SEQ ID NO: 106106 - DNA, 201 bp, Bos taurus; identical to SEQ ID NO: 25015

SEQ ID NO: 106107 - DNA, 201 bp, Bos taurus
agagatttcaaggattcagcccactacaaacccaagtatttttatccttaagtagttataacctaaggaagaaaaggaagatgacttcatttcttctatttgactagcaactcagagtctttaaggtttgtaccaaagaaagaactcgggaccgcactacctcttcattcaggcagtgaatggaaataggttcctagtagg

SEQ ID NO: 106108 - DNA, 201 bp, Bos taurus
tctgtagtttaaacattgaatagcatatcttcttggtcatcataatcaagccatctgtgttgttctgcatagaaattggaaggaaaatctagaagtacacagtgatttcctttgacagctttagagaggtataatttacatgccataaaattcattcatgttaagtgtagaatacaaccacgttaatatatttacaaattt

SEQ ID NO: 106109 - DNA, 201 bp, Bos taurus
cttttgaatatgctgtaactgaaattcagagcagattttggtttttctctttcgcaagccatttatgtgctcacaaacagaccaaactcactatcaaaatagcctatttttacaaacaaaaaattacaaagactatttgaatgtactctctttcacattcttatttggctattatttagataaatccattgaaatgaaagg

SEQ ID NO: 106110 - DNA, 201 bp, Bos taurus; identical to SEQ ID NO: 25016

SEQ ID NO: 106111 - DNA, 201 bp, Bos taurus; identical to SEQ ID NO: 25017

SEQ ID NO: 106112 - DNA, 201 bp, Bos taurus
tcatggttcattagggaacttaaatgtgtttctctcttttcttttaacacagagagtttctctctgaaaaggctcttaaaattttaatttttattcccttgtatttctcttgctcttttattccagtgtcccaggagacttttgcttttaaaaccatatagctttactacagtatcatttgctattagtcattgcaagttg

SEQ ID NO: 106113 - DNA, 201 bp, Bos taurus; identical to SEQ ID NO: 25018

SEQ ID NO: 106114 - DNA, 201 bp, Bos taurus; identical to SEQ ID NO: 25019

SEQ ID NO: 106115 - DNA, 201 bp, Bos taurus; identical to SEQ ID NO: 25020

SEQ ID NO: 106116 - DNA, 201 bp, Bos taurus
aatgtgaacaatttaggggtaaaattgagcttcctaggcttttttagtataattccatgattgtctagagatttgcatcaaaagatcaaaatgaggaggttattatgcgcaggttcaaaatttcaatcacaccatccatgggtggtctcagtaatgagaccctcattgcctaagggaatgaaaatctgcaggctagtttct

SEQ ID NO: 106117 - DNA, 201 bp, Bos taurus; identical to SEQ ID NO: 25021

SEQ ID NO: 106118 - DNA, 201 bp, Bos taurus
gacctaaccaatggggataaaagaaacactaaaacgcatgccagttttcaatgtcagagacccaggaccctcctacctggttagagcttctgctaaattgatcctcttctgcatttcttcctagatcactgcctccccaggatccccagttacactactgtacttaccaagttttctatgagactttgttcttcattaaaa

SEQ ID NO: 106119 - DNA, 201 bp, Bos taurus; identical to SEQ ID NO: 25022

SEQ ID NO: 106120 - DNA, 201 bp, Bos taurus; identical to SEQ ID NO: 25023

SEQ ID NO: 106121 - DNA, 201 bp, Bos taurus
agactccacatctccttgggcctgcctgcaagggagcttccctgtgcacggaaactcctcctgtttcaggactccctccctccttcggggcaaaaggtcccgcccagaacttctctgtctttcccctttttaggtctccatcctctctcctacctcttttcacgttgcttagactgttaccctggaggcctgggttcttct

SEQ ID NO: 106122 - DNA, 201 bp, Bos taurus
tgagaagacatatactacaaatttttttcatgtgatattaagtacaaaatgtgacatgagtgatcaaaactgtgaaaaatcttaagcagtcagcaaaggaaagaggttctatctaaatatcatgtttctttaatattattacaaacaatcaagatacaggttagtgtgcatacagttaagtatagttgtgaaaaatgagag

SEQ ID NO: 106123 - DNA, 201 bp, Bos taurus
aaaggagaagggatgggggtctgggactacagaggggaggaatacaatttacagggagatgggaagagccagtgtctggaaaataaacatttatcatgccgtgtagagataatgggacaagaagaatttcttgagaatcaagaacaatgatagattttttcttataatatttagtcttttgtcttcaattcctagaaaact

SEQ ID NO: 106124 - DNA, 201 bp, Bos taurus; identical to SEQ ID NO: 25024

SEQ ID NO: 106125 - DNA, 201 bp, Bos taurus
acaatactttttgttggatgtactgtgtatagctaagcactgctctgcttatatatatttataatatggtcatacatttatttttaaccgtgctgattttggatttagccaaaaatccaaatgttaggcagtgtaagccttagttttttcagataacttattagaaagaaaaatgatttggagaaaggaggaatgatgaaa

SEQ ID NO: 106126 - DNA, 201 bp, Bos taurus; identical to SEQ ID NO: 25025

SEQ ID NO: 106127 - DNA, 201 bp, Bos taurus; identical to SEQ ID NO: 25026

SEQ ID NO: 106128 - DNA, 201 bp, Bos taurus; identical to SEQ ID NO: 25027

SEQ ID NO: 106129 - DNA, 201 bp, Bos taurus
aatattaatgaaactatcgttaaaaaaaatgaatgtattcccaaaggtgtatatgtcaacccctttttcttgagaagagtgtgagcttttaggaatgtaataaaggaagaaagttacacacacaaacacatatacacagattgttattcttctttccttgaaaacaggtaacttgcgaaaaaacttaaatttgtacttaat

SEQ ID NO: 106130 - DNA, 201 bp, Bos taurus; identical to SEQ ID NO: 25028

SEQ ID NO: 106131 - DNA, 201 bp, Bos taurus; identical to SEQ ID NO: 25029

SEQ ID NO: 106132 - DNA, 201 bp, Bos taurus; identical to SEQ ID NO: 25030

SEQ ID NO: 106133 - DNA, 201 bp, Bos taurus; identical to SEQ ID NO: 25031

SEQ ID NO: 106134 - DNA, 201 bp, Bos taurus; identical to SEQ ID NO: 25032

SEQ ID NO: 106135 - DNA, 201 bp, Bos taurus
aaggtttcactgtattctctgttgaaattcctaagaaagcctaatttacacagataatgaaccctatccatatttacaaataactttagtccttgttgttgaaaaatgggttcacactagtatgtgtgtgtatctgtgtgtgtgtgtgttcaattgtgttcaactctttgggaccccatgaactatagcctgccaggctcc

SEQ ID NO: 106136 - DNA, 201 bp, Bos taurus; identical to SEQ ID NO: 25033

SEQ ID NO: 106137 - DNA, 201 bp, Bos taurus; identical to SEQ ID NO: 25034

SEQ ID NO: 106138 - DNA, 201 bp, Bos taurus; identical to SEQ ID NO: 25035

SEQ ID NO: 106139 - DNA, 201 bp, Bos taurus
gataaataattaacattcagctgaaaatatttataattatcaaaaaatgataaggaaattataagattacacaaaatctatttttacaaatggcatgaaacctgaaaaacacatcaaaaatcaagtcaaaggaaaaggaaacaacaaaaaaagattcatgaaagacttacttaagaaatgtaagagaaattttacaaaatt

SEQ ID NO: 106140 - DNA, 201 bp, Bos taurus
ttaatggatttttcccaaaaggccagggttttaatacagctccaaaataacatatacattacaatttcattttcaatccatgggtaaagttgaattccccattcttttttcttatccttgtggcccaagagggggaaaggggtttatttaggaactaattactgattcctcctttttatcccacttgcctctttctttctt

SEQ ID NO: 106141 - DNA, 201 bp, Bos taurus
gagatgagaaggagtctagagactagcctgttgaagatgggtgaggacaaggaagaagaaacaagggcaggtctggccttcggcattccatggaagatgctgtgcttatgcctgcttggggaaagcaacatcatcccaacaagatgagtgggggccagaggggacccaggtgagaataagacaagcatgaaccctcatgtg

SEQ ID NO: 106142 - DNA, 201 bp, Bos taurus; identical to SEQ ID NO: 25036

SEQ ID NO: 106143 - DNA, 201 bp, Bos taurus
ccagacatctgaaaaccacagtgatactgtctattggtatgttgttttcaaaaaattgtttacatcaaaagagagaagagatactcattttcagcatctcacttcagggtggaaggagagtaagattagggccaagttggggatttgagataaagactgaaaattctggtgagttcaggaagagatctcaacacaactggc

SEQ ID NO: 106144 - DNA, 201 bp, Bos taurus; identical to SEQ ID NO: 25037

SEQ ID NO: 106145 - DNA, 201 bp, Bos taurus; identical to SEQ ID NO: 25038

SEQ ID NO: 106146 - DNA, 201 bp, Bos taurus; identical to SEQ ID NO: 25040

SEQ ID NO: 106147 - DNA, 201 bp, Bos taurus; identical to SEQ ID NO: 25041

SEQ ID NO: 106148 - DNA, 201 bp, Bos taurus
ttcttctttgggccccttagacttatttcagcaaagatgctgcaagttagattggttaaaacctttcagtgatgtgtcattttgctcagagaataagtcacagttctaacaaggggcctagaaagcccttcaaatgtgtcccctcacttttgtatctgtttgatctgacctcatctcctgccaaagctggcttctaggtcc

SEQ ID NO: 106149 - DNA, 201 bp, Bos taurus; identical to SEQ ID NO: 25042

SEQ ID NO: 106150 - DNA, 201 bp, Bos taurus; identical to SEQ ID NO: 25043

SEQ ID NO: 106151 - DNA, 201 bp, Bos taurus
tttggtaaagaagttaactaaaaatcatacaacgaggtgctttgtttctctcaaagcttggttttggttcttccagtagaaacctgggagtggcctctccggttctcaggggctggttctcaagtagccccaggactgagtcttttctccatctcttatccccaggcccccatcccccaaggactgattatctcctcaaac

SEQ ID NO: 106152 - DNA, 201 bp, Bos taurus
gagcagaggggagcccctaggatggttggaaaaggaaaacagggactcttgtagaatatatacataccacattaacactaaatgatagacaatattgattatggtaagatgcgtttaccttgtagttgttacatattaaagttgcaaaaggaagagttcatctttgttccttcctctcccacctggaatttttaaagctgt

SEQ ID NO: 106153 - DNA, 201 bp, Bos taurus; identical to SEQ ID NO: 25044

SEQ ID NO: 106154 - DNA, 201 bp, Bos taurus
gcatcaaaaagaataaactacttaggaataaacctaaggaggtgaaagatttgtactctgaaatctgtaaaactctgatgaaagaaattgaaaataacacaaactaatggaaagatgtactgtgcccatggattgaaaaatgagtattgcttatatgttcaacaggcatcccaaaatgtatgtggccaatacctttcctca

SEQ ID NO: 106155 - DNA, 201 bp, Bos taurus; identical to SEQ ID NO: 25045

SEQ ID NO: 106156 - DNA, 201 bp, Bos taurus; identical to SEQ ID NO: 25046

SEQ ID NO: 106157 - DNA, 201 bp, Bos taurus; identical to SEQ ID NO: 25047

SEQ ID NO: 106158 - DNA, 201 bp, Bos taurus; identical to SEQ ID NO: 25049

SEQ ID NO: 106159 - DNA, 201 bp, Bos taurus; identical to SEQ ID NO: 25050

SEQ ID NO: 106160 - DNA, 201 bp, Bos taurus; identical to SEQ ID NO: 25051

SEQ ID NO: 106161 - DNA, 201 bp, Bos taurus; identical to SEQ ID NO: 25052

SEQ ID NO: 106162 - DNA, 201 bp, Bos taurus; identical to SEQ ID NO: 25054

SEQ ID NO: 106163 - DNA, 201 bp, Bos taurus; identical to SEQ ID NO: 25055

SEQ ID NO: 106164 - DNA, 201 bp, Bos taurus; identical to SEQ ID NO: 25056

SEQ ID NO: 106165 - DNA, 201 bp, Bos taurus
gaagacaggtttattttctcctggctaatgcagcagctgtagcagcagccatggcgtaacctaacacaacacaacctctctccttcttggcacagcagccatagccgaggacacactatattctctcttctcatggctgacccaatcaacacagccgtgatgcgacagtaatggagccgttttctagacagggctcacata

SEQ ID NO: 106166 - DNA, 201 bp, Bos taurus
acctttgaaaaatattctgttaactgattattggggatatcagttaatgcatttctgatgtcaaaacatcagtatttctgctttgtaaatttaccttttcttcattaatcctgaaagctatccatcttcaagggtgtctccaagaagtgttttcaaaggacttggagcttgtgataagatttccttgagaaaaggtcataa

SEQ ID NO: 106167 - DNA, 201 bp, Bos taurus; identical to SEQ ID NO: 25057

SEQ ID NO: 106168 - DNA, 201 bp, Bos taurus; identical to SEQ ID NO: 25058

SEQ ID NO: 106169 - DNA, 201 bp, Bos taurus; identical to SEQ ID NO: 25059

SEQ ID NO: 106170 - DNA, 201 bp, Bos taurus; identical to SEQ ID NO: 25060

SEQ ID NO: 106171 - DNA, 201 bp, Bos taurus; identical to SEQ ID NO: 25061

SEQ ID NO: 106172 - DNA, 201 bp, Bos taurus
tgggttgctgtgccctcctcacgggatacttctaacccagggattgagcatgggtgtatagcatgcgtgggtttaatatttttggtgtgaaggctgttttcggtgtgaatgccccctgcctttttccttggtgtgtgctggccatgctacccttgttgcaggtgtgcagatgtggtggctgggtgctcacttccagagttc

SEQ ID NO: 106173 - DNA, 201 bp, Bos taurus; identical to SEQ ID NO: 25062

SEQ ID NO: 106174 - DNA, 201 bp, Bos taurus
aatggtcagatcaaaggatgcctatttatattgatgacattaatggtcagaaaagtcataccttctgaaatgtcattgtcctagtgtacaattctgcccccaaatcagattcaccccatgagaggtggggagagagacctagaaacagtattgtactgaaacagtctccattgtccatcctagacatcatattaaaaagga

SEQ ID NO: 106175 - DNA, 201 bp, Bos taurus
tattttctttagttcttaacaactaccttactaagtaagtactgttattcccatcttatctagatgaggaacttgagtctcagaaaggccaagtggcttattcaaggctcaaagctactcagtggtacagtcaaagccaaacccaagtacacctcagttctggctcagaacctttctaacacaccattcccactgcaggcc

SEQ ID NO: 106176 - DNA, 201 bp, Bos taurus; identical to SEQ ID NO: 25064

SEQ ID NO: 106177 - DNA, 201 bp, Bos taurus
gcttcatgctaacagtgatcatcagaaagaactgagcgttgtcaaaggttatctttccattcaaaggtaccacatgagaggcggagatagaacttcataccaaatttcgtcctgtgaatagaaatcattgaatgactgtccaaagaggccaggagggttttaataaaatatccaaagaccagggcaacagtgaccttgaat

SEQ ID NO: 106178 - DNA, 201 bp, Bos taurus
cccttccccaaaccaagaagatgtgagggccattgtctgaaatcctcatccagagaaaccctgtattctggaagaccagtccacaggcaaggatgtgtgtcgttactaaagatgggccattccttgaaaatatgctgaacactgaaactctggctcccttttgcttaatgaccaaaatgaaagtggttgcctcaaagaggc

SEQ ID NO: 106179 - DNA, 201 bp, Bos taurus; identical to SEQ ID NO: 25067

SEQ ID NO: 106180 - DNA, 201 bp, Bos taurus; identical to SEQ ID NO: 25069

SEQ ID NO: 106181 - DNA, 201 bp, Bos taurus; identical to SEQ ID NO: 25070

SEQ ID NO: 106182 - DNA, 201 bp, Bos taurus; identical to SEQ ID NO: 25074

SEQ ID NO: 106183 - DNA, 201 bp, Bos taurus; identical to SEQ ID NO: 25075

SEQ ID NO: 106184 - DNA, 201 bp, Bos taurus; identical to SEQ ID NO: 25080

SEQ ID NO: 106185 - DNA, 201 bp, Bos taurus; identical to SEQ ID NO: 25081

SEQ ID NO: 106186 - DNA, 201 bp, Bos taurus; identical to SEQ ID NO: 25082

SEQ ID NO: 106187 - DNA, 201 bp, Bos taurus; identical to SEQ ID NO: 25084

SEQ ID NO: 106188 - DNA, 201 bp, Bos taurus; identical to SEQ ID NO: 25085

SEQ ID NO: 106189 - DNA, 201 bp, Bos taurus; identical to SEQ ID NO: 25087

SEQ ID NO: 106190 - DNA, 201 bp, Bos taurus; identical to SEQ ID NO: 25096

SEQ ID NO: 106191 - DNA, 201 bp, Bos taurus; identical to SEQ ID NO: 25097

SEQ ID NO: 106192 - DNA, 201 bp, Bos taurus; identical to SEQ ID NO: 25098

SEQ ID NO: 106193 - DNA, 201 bp, Bos taurus; identical to SEQ ID NO: 25099

SEQ ID NO: 106194 - DNA, 201 bp, Bos taurus; identical to SEQ ID NO: 25100

SEQ ID NO: 106195 - DNA, 201 bp, Bos taurus; identical to SEQ ID NO: 25102

SEQ ID NO: 106196 - DNA, 201 bp, Bos taurus; identical to SEQ ID NO: 25103

SEQ ID NO: 106197 - DNA, 201 bp, Bos taurus; identical to SEQ ID NO: 25105

SEQ ID NO: 106198 - DNA, 201 bp, Bos taurus; identical to SEQ ID NO: 25106

SEQ ID NO: 106199 - DNA, 201 bp, Bos taurus; identical to SEQ ID NO: 25107

SEQ ID NO: 106200 - DNA, 201 bp, Bos taurus; identical to SEQ ID NO: 25108

SEQ ID NO: 106201 - DNA, 201 bp, Bos taurus; identical to SEQ ID NO: 25110

SEQ ID NO: 106202 - DNA, 201 bp, Bos taurus; identical to SEQ ID NO: 25111

SEQ ID NO: 106203 - DNA, 201 bp, Bos taurus; identical to SEQ ID NO: 25112

SEQ ID NO: 106204 - DNA, 201 bp, Bos taurus; identical to SEQ ID NO: 25116

SEQ ID NO: 106205 - DNA, 201 bp, Bos taurus; identical to SEQ ID NO: 25117

SEQ ID NO: 106206 - DNA, 201 bp, Bos taurus; identical to SEQ ID NO: 25119

SEQ ID NO: 106207 - DNA, 201 bp, Bos taurus; identical to SEQ ID NO: 25120

SEQ ID NO: 106208 - DNA, 201 bp, Bos taurus; identical to SEQ ID NO: 25128

SEQ ID NO: 106209 - DNA, 201 bp, Bos taurus; identical to SEQ ID NO: 25129

SEQ ID NO: 106210 - DNA, 201 bp, Bos taurus; identical to SEQ ID NO: 25131

SEQ ID NO: 106211 - DNA, 201 bp, Bos taurus; identical to SEQ ID NO: 25134

SEQ ID NO: 106212 - DNA, 201 bp, Bos taurus; identical to SEQ ID NO: 25135

SEQ ID NO: 106213 - DNA, 201 bp, Bos taurus; identical to SEQ ID NO: 25139

SEQ ID NO: 106214 - DNA, 201 bp, Bos taurus
ggagctgcagagtgagcgggggcttcagatgcactggggcactgagttggagtaaaaagggggtgcccacagtagcactcgacagggacagactcgggccacttcgcctggttccctgagtgcagccaagtctggattcagaagcgtttccatgggaaggctgctctgtgagtccagacgagatatagtgctagggccatc

SEQ ID NO: 106215 - DNA, 201 bp, Bos taurus
gtttgttatgagtattaaaattgttcttatttgaatagcacttagaacgttgcctggcacataggcagcaatatgtgttagttcaaaaaagttcttttgagatctttgctgctaataaatactacttgacaccatatacatacctagacacatgtggacgtctatcctgtaggagcttgattcaatgtgacttattatgtt

SEQ ID NO: 106216 - DNA, 201 bp, Bos taurus; identical to SEQ ID NO: 25140

SEQ ID NO: 106217 - DNA, 201 bp, Bos taurus
atgttggccttgaaaggccttgtggcttccattttcaccattttggaacactgtgctcagtccagcctggaggatagaggacacgtggaacagagccaagcgctccagctgaggcctcctatactaacatgtctgtgcttgcaccaaatatttgacacacagatgaagccatcttacattatcctgtcccaggcaaaccac

SEQ ID NO: 106218 - DNA, 201 bp, Bos taurus
taaagagcctcttgatgagggtgaaagaggagagtaaaaagctggcttaaacttaatgtcaaaacaaacaaacaaaacccaaacccaaagttaacacaccatagttggctgttatgtctctggtttctgctaatctacaacagaagccctcagaattttgttgactttttatgataatgatttgctctaaggggccacact

SEQ ID NO: 106219 - DNA, 201 bp, Bos taurus; identical to SEQ ID NO: 25141

SEQ ID NO: 106220 - DNA, 201 bp, Bos taurus
agcggggagctggagtccctgtgccagggtgagggcagccactgaagcagatgctgggcaactgagaagaactattgatttcagtcgctcagattcctcacggcggccgcctaccccctccctctggtgggagggcagaggtagctgggagctgtgttgcccaccactgcccatcaccagcttctggcttcaaacagaagg

SEQ ID NO: 106221 - DNA, 201 bp, Bos taurus; identical to SEQ ID NO: 25142

SEQ ID NO: 106222 - DNA, 201 bp, Bos taurus
tggctttccatgaaagtatgagatctggcaaatctcatgctgaattctctcatggggactcttggagctgaatgttgtcagccttcctgcagtcaggtgtttctggtttcccagagtccccatacaactgctattgttcccaacctattcacccacttaaaatacctgcatgacctcaggtagcattttgagctgacaaac

SEQ ID NO: 106223 - DNA, 201 bp, Bos taurus
caatgtggaactaactcatagatgagagatgaataaaggatagtgagaaaaatttagaatgatgtgttagggacctgataaaaacagagagagcaggaagctatagtgtaagcacattaggagagcagtcctgggagctggaggagtaggagacattgtgaaaaaagaaaaccaaatctaagagtcggataggattttaaa

SEQ ID NO: 106224 - DNA, 201 bp, Bos taurus
actcactacagtcctaagagctatggccaggattattatcctgttttacagatgagaaaactgaaatggacaggttcaattgacttgcacgaagtcacacggtgaataaacagcaggccacggaggcaaggctaggcctagtgcaggtgttcgtaaccaccattaaaggttggttgattcagtgagttaaattcagcaaac

SEQ ID NO: 106225 - DNA, 201 bp, Bos taurus; identical to SEQ ID NO: 25143

SEQ ID NO: 106226 - DNA, 201 bp, Bos taurus; identical to SEQ ID NO: 25144

SEQ ID NO: 106227 - DNA, 201 bp, Bos taurus; identical to SEQ ID NO: 25145

SEQ ID NO: 106228 - DNA, 201 bp, Bos taurus; identical to SEQ ID NO: 25147

SEQ ID NO: 106229 - DNA, 201 bp, Bos taurus; identical to SEQ ID NO: 25148

SEQ ID NO: 106230 - DNA, 201 bp, Bos taurus; identical to SEQ ID NO: 25149

SEQ ID NO: 106231 - DNA, 201 bp, Bos taurus; identical to SEQ ID NO: 25150

SEQ ID NO: 106232 - DNA, 201 bp, Bos taurus
tgaactctctcattgtaattttcttatttctggtagttgccttttcttttccacttagagaatttcctttaatgtttgttggaaagctggcctgatactgatgaattctcttagcttttgtttgtctgtaaagcttttgatttctctgtggaatctgaagggcggctgcttaaagtcttcctgaccatggcctgcccactg

SEQ ID NO: 106233 - DNA, 201 bp, Bos taurus; identical to SEQ ID NO: 25151

SEQ ID NO: 106234 - DNA, 201 bp, Bos taurus; identical to SEQ ID NO: 25152

SEQ ID NO: 106235 - DNA, 201 bp, Bos taurus
tgccaagttaactatatgatataaaaagagaaagggaaaacagcaaaatttaaagcaaaatatatttactgcagttttggaaaaataaagaaaagagcttggaaattgatatagcaactgttattgttcagatatttgagaatcactgctctttaatattttaagtgggcccctctctgtcaaacaacctccatagtctag

SEQ ID NO: 106236 - DNA, 201 bp, Bos taurus; identical to SEQ ID NO: 25153

SEQ ID NO: 106237 - DNA, 201 bp, Bos taurus
ccatctatatctgtatcctgagatcaagggaagctttgactttcaccaaggatactctctgaatgctgtgcagctttgggtcaacaaagctgtcttctgtgagctgccttgtttgataagacattccattcattcagttgtttgtgtgtttatgcatgctaagttgcttcagtcatatctgactctacgaccctatggact

SEQ ID NO: 106238 - DNA, 201 bp, Bos taurus; identical to SEQ ID NO: 25154

SEQ ID NO: 106239 - DNA, 201 bp, Bos taurus
ttaacatcagaacttccacttttcaataagaaggccttcattcaatgtactttgtttgggggtggtatgagggaattcactgttcgctggtcacaggtacgaatgtaatttggggctggcccagctgagctccccccatcgcctgatatgaccttggactgtcagcctccatctttgttattatgtggataggattttcta

SEQ ID NO: 106240 - DNA, 201 bp, Bos taurus; identical to SEQ ID NO: 25155

SEQ ID NO: 106241 - DNA, 201 bp, Bos taurus
aaacagagctttgggttacctgcatgattctgagaatgtaatgcgcctaacccaaccctaccttcagttatgtatgttttatattacaactgtgtatcccgttggaagaaatgtttttgaagtggttccaggtgtgtgtgaagtgatgacacttgtctggaggccgtatcagtcacacaggtcctgccctgtgtctggatt

SEQ ID NO: 106242 - DNA, 201 bp, Bos taurus
tctgtgacatgggcaccattacttgtgggaaaggaaactgaggctcagaaatgttaagaaattttcttaaggtcacacaactggttaagtagttgggccaagaagagactttagtgtgtgtatgtgtccaaatcctatccaagacaggaattatttcttcgacatctctcatagccattagactctgtgaaccatatggtg

SEQ ID NO: 106243 - DNA, 201 bp, Bos taurus
agcaggtttggtgacaacacatgaggccttgaggaatgggagaagcacaaatcccagggaaagagtgcggaatgagacagtggaagctgagaaatccatctgacttccatgagaccttgcaagaaccctactgtgcccacctccaccctttcctcctgaacagctcctccccttcaaatgcttcagaagcttgccagggaa

SEQ ID NO: 106244 - DNA, 201 bp, Bos taurus
catttctataagctgctgcagtattcgaccctggtgacatagaaaaaaataagatgtgattatagggttacatttcatatgactgcttggaatttcctagtaggtgggtttgctgaacagatatagataaatacacaggcatacaagaaactattttttttaaatacagtacttgtttttcaaagagataccctaggactc

SEQ ID NO: 106245 - DNA, 201 bp, Bos taurus
aaataacaatggaaacctgacattgttgtttttaataaaatagatttattggaatctacttttgaatctttggttttggcacaccaccagtttggaaacactggtattctacattgtgatagagacttgatatcaaattagaatatgtgctgcagaactttaatattaaaaactatttttttaaagaaggaaaattcatcc

SEQ ID NO: 106246 - DNA, 201 bp, Bos taurus
atttggtgctcatactggctgaggcctcagatggggtgagaaaggatggcattgcctacagaaggcagcttagctcagtctacattggaacacacatgcatgggcctcagccaggtctgacgagtagagtctgcagtcttgaaaaactaactcaatatctgtgagtcatttttctcatttgtaaaatgagattaatgacag

SEQ ID NO: 106247 - DNA, 201 bp, Bos taurus
ttattcttttgttctaagtagaaatgtctgacttgtttccagactgaagaacttgggacaagttgtgttgtcaacatccaatgcaagttatcagaatttatatatactcaaaggccaggtcctttttaagtctatgattatatactatgtttggcactctgacctggaaaaaggctggatcttcaaaagaagtcctgaaag

SEQ ID NO: 106248 - DNA, 201 bp, Bos taurus
cattcctagtctgggaagtaacctcctgcaagtcacatggcacagccaaaaagaaaagaaaatccagtatgcaagtttgtgcctatttcttccctgagcttggctccagggttgcatgcatgctaaattgcttcagtcatgttagattctctgcgactccatggactatagcccatcaggctcctctgtatgggattctcc

SEQ ID NO: 106249 - DNA, 201 bp, Bos taurus
gtttattgagagacagggtcatgtttaaggttatagtctccatgccacagactgtgtatgacatataacagagaaaacttatgactgagtaactaaaataaatgaataatgaatggatacatgaatgaaaaaaatttgcatacatatatgacccccaatgtccttttataatcttgaaatatagcactaaattagctacat

SEQ ID NO: 106250 - DNA, 201 bp, Bos taurus; identical to SEQ ID NO: 25156

SEQ ID NO: 106251 - DNA, 201 bp, Bos taurus; identical to SEQ ID NO: 25157

SEQ ID NO: 106252 - DNA, 201 bp, Bos taurus; identical to SEQ ID NO: 25158

SEQ ID NO: 106253 - DNA, 201 bp, Bos taurus; identical to SEQ ID NO: 25159

SEQ ID NO: 106254 - DNA, 201 bp, Bos taurus
tctgcagccagttaaggttctctggttttatggactcctgtgattacactgcgcctatggggatgatccagaataatttccccagctcaaggcctgtaattttaatcaaatctacaatgactctgccatgtaaggttgttaggctgcacccacaggcctgtaagccttgtagctagttgccaggcctcaagacagaagaaa

SEQ ID NO: 106255 - DNA, 201 bp, Bos taurus
gaaccagaagtttgatgtcaccaaggcctgggcggatcggcttcagaatgctagaggagtgcctgtcgttaaaccattgagatctggacgaagaatctgtaaagtgaggccccctgcagtaggaagagtaagaatctgagaggtaagtcccagaacggacttgtgtaactaagagggaattttggaaagggacggcggcac

SEQ ID NO: 106256 - DNA, 201 bp, Bos taurus; identical to SEQ ID NO: 25161

SEQ ID NO: 106257 - DNA, 201 bp, Bos taurus; identical to SEQ ID NO: 25162

SEQ ID NO: 106258 - DNA, 201 bp, Bos taurus; identical to SEQ ID NO: 25163

SEQ ID NO: 106259 - DNA, 201 bp, Bos taurus; identical to SEQ ID NO: 25164

SEQ ID NO: 106260 - DNA, 201 bp, Bos taurus; identical to SEQ ID NO: 25166

SEQ ID NO: 106261 - DNA, 201 bp, Bos taurus; identical to SEQ ID NO: 25168

SEQ ID NO: 106262 - DNA, 201 bp, Bos taurus; identical to SEQ ID NO: 25169

SEQ ID NO: 106263 - DNA, 201 bp, Bos taurus; identical to SEQ ID NO: 25170

SEQ ID NO: 106264 - DNA, 201 bp, Bos taurus
agatcgcagaggaaatgtggaggaatgtgaatggtattattttatccagcaaaaaacagagacttgtctgcttctctttcccagcacggcctcactacgatgtcataatgttcgatgtggacagtaaggacccaaccctgggaatgagctgtccacccccagcatttgtggcccagcttttcctgcagaaggtcaaaagca

SEQ ID NO: 106265 - DNA, 201 bp, Bos taurus; identical to SEQ ID NO: 25171

SEQ ID NO: 106266 - DNA, 201 bp, Bos taurus; identical to SEQ ID NO: 25172

SEQ ID NO: 106267 - DNA, 201 bp, Bos taurus
tgtgctcccagagagcaagtggttacttcatgaaactattgccagtgtaatgttcatatataaagttgtcccaagtatgacctctctttggttgtatttaattataaatggttttctgccgccatagactgtttggtaccagatgcataaagtccttttttaagcaatttttaaagagagctttatagaagttttgattgt

SEQ ID NO: 106268 - DNA, 201 bp, Bos taurus; identical to SEQ ID NO: 25173

SEQ ID NO: 106269 - DNA, 201 bp, Bos taurus; identical to SEQ ID NO: 25174

SEQ ID NO: 106270 - DNA, 201 bp, Bos taurus; identical to SEQ ID NO: 25175

SEQ ID NO: 106271 - DNA, 201 bp, Bos taurus
gaagatttcttctggcccttacaagtcttgtctgggagcagtttgaaggacttccttatccctgagagagagccaagaccaggagtggagtgacacctccgtggatgtcccctgcacaccccaaatccagtgggtccccctgactcattccctccaagagctccccatgccagggagcagtaccaccaccacccccccaac

SEQ ID NO: 106272 - DNA, 201 bp, Bos taurus; identical to SEQ ID NO: 25178

SEQ ID NO: 106273 - DNA, 201 bp, Bos taurus; identical to SEQ ID NO: 25179

SEQ ID NO: 106274 - DNA, 201 bp, Bos taurus; identical to SEQ ID NO: 25181

SEQ ID NO: 106275 - DNA, 201 bp, Bos taurus; identical to SEQ ID NO: 25182

SEQ ID NO: 106276 - DNA, 201 bp, Bos taurus; identical to SEQ ID NO: 25183

SEQ ID NO: 106277 - DNA, 201 bp, Bos taurus; identical to SEQ ID NO: 25184

SEQ ID NO: 106278 - DNA, 201 bp, Bos taurus
ggctgtgacctgggggagattgatggccagcctgtgcggtggatgctaacagtttccctgatttatagagttacttacgctaagtgaggccacttagacgtgtctggatagtaaaccttttaactggactaaaaaatcataataaataaataaaccaaggggcacacgtagggcccagcagctgggcccccccagttgccc

SEQ ID NO: 106279 - DNA, 201 bp, Bos taurus
agatgtttgcctcagcaaggccaactgaggccacatggtgaggccaccatgtaactttccagctgatagccggggctgaggtcccagccaacattggccatctgatgaatgaagaagacagacacctccacatggtcccagccatggaaccacccccagctttcaagtcttcctagctgaggcccccagatattgtggaac

SEQ ID NO: 106280 - DNA, 201 bp, Bos taurus
aagacgtgaaaacaacacgcgacagccagggtttggcaagagaccaacatcagctaggacttcctacctgagcacaggccatttggctgtgactctgtaacatgaaatttgtatcaactctgattccttcctttaagcgatcagaggctttcctaaaatttgatggggctcaaattcaagtttcataaatggccttttgaa

SEQ ID NO: 106281 - DNA, 201 bp, Bos taurus
agcctggcacacagaaagagctcagtagagtaagctatcctatcactattgttgtgatgtggttgtttatacagttatggacatctgccagaatggtgtcagaaattcggacggaaggaagaactaagacacacaccaatgtcttcaaacagagcaatggtagaggacagtgtaattgaatgatacactttggcataaaca

SEQ ID NO: 106282 - DNA, 201 bp, Bos taurus
aagaacaaaacagaaaggatccgatttcaaaaatggataaaggggaatttcctggtggtcaagtgtttaggactccatgctttcactaccgagggcctgcattcaatccctggtccctgaactaagatctaacaagccacttggtgcagctaagggggaaaataatggatgaaggatttgaatatacagttctccaaaaaa

SEQ ID NO: 106283 - DNA, 201 bp, Bos taurus
tctccacttcccaccctacccccttcctttcctaggaaagaaagagctcagagctgtggtttggcagccccactgctttgagacggcacctgtggacagaatttttctgggggaatccagaatgcgtgcctgcattctggtgcctgcatctgtgatgtggtgcgggaaggagacaaatcgacacacacacacatgtgcccc

SEQ ID NO: 106284 - DNA, 201 bp, Bos taurus
acccagcctttcctgtctgaccttcacacatagaaaacgtggccaatcagaccagggcacagatcaacagaacacacagtgggccgtgcagcttcgctgcattgcctgtctgtctgctgaatttccgctggttgggtcagagtgggcttggagagaggccagtgcgaaatgaaggggtgagtggggaactgagtctacaga

SEQ ID NO: 106285 - DNA, 201 bp, Bos taurus; identical to SEQ ID NO: 25186

SEQ ID NO: 106286 - DNA, 201 bp, Bos taurus; identical to SEQ ID NO: 25187

SEQ ID NO: 106287 - DNA, 201 bp, Bos taurus; identical to SEQ ID NO: 25188

SEQ ID NO: 106288 - DNA, 201 bp, Bos taurus; identical to SEQ ID NO: 25189

SEQ ID NO: 106289 - DNA, 201 bp, Bos taurus; identical to SEQ ID NO: 25190

SEQ ID NO: 106290 - DNA, 201 bp, Bos taurus; identical to SEQ ID NO: 25191

SEQ ID NO: 106291 - DNA, 201 bp, Bos taurus; identical to SEQ ID NO: 25192

SEQ ID NO: 106292 - DNA, 201 bp, Bos taurus; identical to SEQ ID NO: 25193

SEQ ID NO: 106293 - DNA, 201 bp, Bos taurus; identical to SEQ ID NO: 25194

SEQ ID NO: 106294 - DNA, 201 bp, Bos taurus; identical to SEQ ID NO: 25195

SEQ ID NO: 106295 - DNA, 201 bp, Bos taurus; identical to SEQ ID NO: 25196

SEQ ID NO: 106296 - DNA, 201 bp, Bos taurus; identical to SEQ ID NO: 25197

SEQ ID NO: 106297 - DNA, 201 bp, Bos taurus; identical to SEQ ID NO: 25198

SEQ ID NO: 106298 - DNA, 201 bp, Bos taurus; identical to SEQ ID NO: 25199

SEQ ID NO: 106299 - DNA, 201 bp, Bos taurus; identical to SEQ ID NO: 25200

SEQ ID NO: 106300 - DNA, 201 bp, Bos taurus; identical to SEQ ID NO: 25202

SEQ ID NO: 106301 - DNA, 201 bp, Bos taurus; identical to SEQ ID NO: 25203

SEQ ID NO: 106302 - DNA, 201 bp, Bos taurus; identical to SEQ ID NO: 25205

SEQ ID NO: 106303 - DNA, 201 bp, Bos taurus; identical to SEQ ID NO: 25206

SEQ ID NO: 106304 - DNA, 201 bp, Bos taurus; identical to SEQ ID NO: 25207

SEQ ID NO: 106305 - DNA, 201 bp, Bos taurus; identical to SEQ ID NO: 25209

SEQ ID NO: 106306 - DNA, 201 bp, Bos taurus
ccctgccctggccacagagcggcagctgccaggagctactcatggtaccaggaaggtcacaggctctgaaagtgggaggagagcaaatattgaagcctcagttgagggcccctgagcaagagaatgagtgaaatggggctaatgaacacagcgctgcccggatgcacgactgccgaatcgtatttaaaattactccttagt

SEQ ID NO: 106307 - DNA, 201 bp, Bos taurus; identical to SEQ ID NO: 25210

SEQ ID NO: 106308 - DNA, 201 bp, Bos taurus; identical to SEQ ID NO: 25211

SEQ ID NO: 106309 - DNA, 201 bp, Bos taurus
cagcacagaagaccccagagcttcaaaattcagcccctcttgccttaaacaactgcattcttattccaaacaaccttggccacattaggcaggcatccccgaacctgagtgggtcccagaacttcaggaccacctgctaatgcaaattcccaggccctgctcaccagagtgctcatttagtgacttggagtggtatcctgg

SEQ ID NO: 106310 - DNA, 201 bp, Bos taurus
gaaaagaatgctaagtgaatacatttctttgatctgcagagtgtcaaaatggcaagataatacaggctgctctttctttcctcccaaaaccaaccttggagaaactattgaaaaatgaacaagccacaaagatgtggcttccataaagtaagaacagaaaatagtaacaaaaggttggaaactctggctaaaacctgtctt

SEQ ID NO: 106311 - DNA, 201 bp, Bos taurus
ttgtctcaccgccctggcattctttttgctccctgggaaagttgatctttaacaagggatgttcacttgtccctctcattactttggctgaaggctttgcagatgaactgctgagtgtccagccagcatttgacatccttttctcttgaatggtgaaattcaaatcatgtgttgctgtctttcctctccaatcattttctt

SEQ ID NO: 106312 - DNA, 201 bp, Bos taurus
gtggaaagggctctgaggggccgcaggcatgtgtgagtggatgaatgcacactcctggggcctctgtcacaagggccatcaggggataggccaacatcaccgcccttggcttttacccccaccaagtaacccctgcccgcctgtggtcagctagagacacccagattacctttcagcaggggcagaggcctggagtagggg

SEQ ID NO: 106313 - DNA, 201 bp, Bos taurus; identical to SEQ ID NO: 25214

SEQ ID NO: 106314 - DNA, 201 bp, Bos taurus; identical to SEQ ID NO: 25215

SEQ ID NO: 106315 - DNA, 201 bp, Bos taurus
agattagcatttgattcagtagactgagtagacttccacacgcaccaaggtgggtgggaatcatgaaatccatttcaggccatactgaacaaaaaagcaaaagagggcagaattctctctcgcttgagctgggatgtcgatcttttcctgcccttgaacatcagagctactaggtctcaggcccttagacttggactcctt

SEQ ID NO: 106316 - DNA, 201 bp, Bos taurus; identical to SEQ ID NO: 25218

SEQ ID NO: 106317 - DNA, 201 bp, Bos taurus; identical to SEQ ID NO: 25219

SEQ ID NO: 106318 - DNA, 201 bp, Bos taurus; identical to SEQ ID NO: 25220

SEQ ID NO: 106319 - DNA, 201 bp, Bos taurus; identical to SEQ ID NO: 25221

SEQ ID NO: 106320 - DNA, 201 bp, Bos taurus; identical to SEQ ID NO: 25222

SEQ ID NO: 106321 - DNA, 201 bp, Bos taurus
tatgaggattaagtgagagcaaggatatgactttcttaatgcaatgcctggcacataaacagtcctccagaagtgctgctggtgttaccttttgcttactacttaaccgtaccaagaaggatttgtagtttacccaaatattttctttttttataatttatttattttttgactgtgctgggctttcgttgctgcatgcag

SEQ ID NO: 106322 - DNA, 201 bp, Bos taurus; identical to SEQ ID NO: 25223

SEQ ID NO: 106323 - DNA, 201 bp, Bos taurus; identical to SEQ ID NO: 25224

SEQ ID NO: 106324 - DNA, 201 bp, Bos taurus; identical to SEQ ID NO: 25225

SEQ ID NO: 106325 - DNA, 201 bp, Bos taurus; identical to SEQ ID NO: 25226

SEQ ID NO: 106326 - DNA, 201 bp, Bos taurus
ttgctgtaaagctgtcaggtggagctacagtcaattgcaggctagactggggctggagggtccacttccaaaatggtgcactcacatcatgctagttatttgtaggaggcctcagatcatcccccattgggcttccatttccatgggctacttgagtgttcttggaatacaggggctggcttcaatcagaatgaggactcc

SEQ ID NO: 106327 - DNA, 201 bp, Bos taurus; identical to SEQ ID NO: 25227

SEQ ID NO: 106328 - DNA, 201 bp, Bos taurus; identical to SEQ ID NO: 25228

SEQ ID NO: 106329 - DNA, 201 bp, Bos taurus; identical to SEQ ID NO: 25229

SEQ ID NO: 106330 - DNA, 201 bp, Bos taurus; identical to SEQ ID NO: 25230

SEQ ID NO: 106331 - DNA, 201 bp, Bos taurus; identical to SEQ ID NO: 25231

SEQ ID NO: 106332 - DNA, 201 bp, Bos taurus; identical to SEQ ID NO: 25232

SEQ ID NO: 106333 - DNA, 201 bp, Bos taurus; identical to SEQ ID NO: 25233

SEQ ID NO: 106334 - DNA, 201 bp, Bos taurus
acatgaatggctggctataaagcagtactcgttttctttatggccatttgccttatgtaggccattaagactttaccactcaagcaaggaggcctaacttgatttttaaataagaacgtgttatgacttcaagacatttgtacactccagctggaaggcatctggcctttttgtgaaggacaaaggacttggtgtcctggc

SEQ ID NO: 106335 - DNA, 201 bp, Bos taurus; identical to SEQ ID NO: 25235

SEQ ID NO: 106336 - DNA, 201 bp, Bos taurus; identical to SEQ ID NO: 25236

SEQ ID NO: 106337 - DNA, 201 bp, Bos taurus
ctggggctccacatatctcattattttaaacatgtctaaccagatggagactagaatctaatattttgcctttcccaacaaacatagctgatatccacagtagagcatgagtttacacagctgaatagccaagatccagtaaagaaagacaaaaacagacagcatacactatctgaagcagaatcttttgaacaagtagaa

SEQ ID NO: 106338 - DNA, 201 bp, Bos taurus
gccaagtgcctctaatgctctcctgggtattttatgattcatctcgctagaacctctttatcttctcgaaagtttgctgagctgtcaatcctcctttagcggacctcagataacatcatatcctgctctctgttcctgggaccctcttttgtgggtctgagtcctgtctagatgatgcaggctctgcccagaccaccacaa

SEQ ID NO: 106339 - DNA, 201 bp, Bos taurus
ccttgtgcccacttctggaattccaaataagcctgccacctatgagcaagcattctcccacaggaagcagaggagctgctctgaaattaggagcataactattgtagtcttgtggcctagggcctgcttacttccaaaaccagggtgcttgctctctgagcctgaggctgtgtctggagttcatcaaaacttctactctgg

SEQ ID NO: 106340 - DNA, 201 bp, Bos taurus
tgttgcccagctgcctgcagctacatgtgcgctggagccatgtgccctgtgtcccctgctgccaccggattctctggggctgcgagctcagctgccgtggggggaaggccaggactgcaggtaccacctctcatatttcctcagttctgcctcctatattccacttcactgacctttagatgtacagatatttggaattct

SEQ ID NO: 106341 - DNA, 201 bp, Bos taurus; identical to SEQ ID NO: 25245

SEQ ID NO: 106342 - DNA, 201 bp, Bos taurus; identical to SEQ ID NO: 25246

SEQ ID NO: 106343 - DNA, 201 bp, Bos taurus; identical to SEQ ID NO: 25247

SEQ ID NO: 106344 - DNA, 201 bp, Bos taurus
aatgccagtgtggagctcatggcctcagacaccgccacctgctactccttccctgtgcatctgtctgcagactcctaggcccgcgccttcatcccaggaaggttttagctcttgcttactgcctctctccccatcttttctcctgacagcagttcttggttagtagatgacccttcttgtacgctggcctcttggttcctt

SEQ ID NO: 106345 - DNA, 201 bp, Bos taurus; identical to SEQ ID NO: 25248

SEQ ID NO: 106346 - DNA, 201 bp, Bos taurus; identical to SEQ ID NO: 25249

SEQ ID NO: 106347 - DNA, 201 bp, Bos taurus; identical to SEQ ID NO: 25250

SEQ ID NO: 106348 - DNA, 201 bp, Bos taurus; identical to SEQ ID NO: 25251

SEQ ID NO: 106349 - DNA, 201 bp, Bos taurus; identical to SEQ ID NO: 25253

SEQ ID NO: 106350 - DNA, 201 bp, Bos taurus; identical to SEQ ID NO: 25255

SEQ ID NO: 106351 - DNA, 201 bp, Bos taurus; identical to SEQ ID NO: 25256

SEQ ID NO: 106352 - DNA, 201 bp, Bos taurus; identical to SEQ ID NO: 25257

SEQ ID NO: 106353 - DNA, 201 bp, Bos taurus; identical to SEQ ID NO: 25259

SEQ ID NO: 106354 - DNA, 201 bp, Bos taurus; identical to SEQ ID NO: 25261

SEQ ID NO: 106355 - DNA, 201 bp, Bos taurus; identical to SEQ ID NO: 25264

SEQ ID NO: 106356 - DNA, 201 bp, Bos taurus; identical to SEQ ID NO: 25265

SEQ ID NO: 106357 - DNA, 201 bp, Bos taurus; identical to SEQ ID NO: 25266

SEQ ID NO: 106358 - DNA, 201 bp, Bos taurus; identical to SEQ ID NO: 25268

SEQ ID NO: 106359 - DNA, 201 bp, Bos taurus; identical to SEQ ID NO: 25270

SEQ ID NO: 106360 - DNA, 201 bp, Bos taurus; identical to SEQ ID NO: 25274

SEQ ID NO: 106361 - DNA, 201 bp, Bos taurus; identical to SEQ ID NO: 25276

SEQ ID NO: 106362 - DNA, 201 bp, Bos taurus; identical to SEQ ID NO: 25277

SEQ ID NO: 106363 - DNA, 201 bp, Bos taurus; identical to SEQ ID NO: 25278

SEQ ID NO: 106364 - DNA, 201 bp, Bos taurus; identical to SEQ ID NO: 25280

SEQ ID NO: 106365 - DNA, 201 bp, Bos taurus; identical to SEQ ID NO: 25282

SEQ ID NO: 106366 - DNA, 201 bp, Bos taurus; identical to SEQ ID NO: 25283

SEQ ID NO: 106367 - DNA, 201 bp, Bos taurus; identical to SEQ ID NO: 25285

SEQ ID NO: 106368 - DNA, 201 bp, Bos taurus; identical to SEQ ID NO: 25286

SEQ ID NO: 106369 - DNA, 201 bp, Bos taurus; identical to SEQ ID NO: 25287

SEQ ID NO: 106370 - DNA, 201 bp, Bos taurus; identical to SEQ ID NO: 25289

SEQ ID NO: 106371 - DNA, 201 bp, Bos taurus; identical to SEQ ID NO: 25290

SEQ ID NO: 106372 - DNA, 201 bp, Bos taurus; identical to SEQ ID NO: 25291

SEQ ID NO: 106373 - DNA, 201 bp, Bos taurus; identical to SEQ ID NO: 25292

SEQ ID NO: 106374 - DNA, 201 bp, Bos taurus; identical to SEQ ID NO: 25293

SEQ ID NO: 106375 - DNA, 201 bp, Bos taurus
tccctggccaggtgagaccacaagttttgctctgcagatggtgaactcataggttgtcactctgttcaagtgccactgtagcaaagcaagcaaaatggtccgattctttggcaacgaccaggggcccatgagaagaaaatatatgggcagctaagatcttatttgatttttttttaatgaaaaatgttccaaacctaataa

SEQ ID NO: 106376 - DNA, 201 bp, Bos taurus; identical to SEQ ID NO: 25297

SEQ ID NO: 106377 - DNA, 201 bp, Bos taurus; identical to SEQ ID NO: 25298

SEQ ID NO: 106378 - DNA, 201 bp, Bos taurus
aggatggctgttgtcttgctctctggtcccctgctcgaccaatgccgtttcacctgcaccctattcatgtgacgggccttcttacatccttgacccaggccgcagctggtgattattctaactttaaatcagaactctcctctatgtttatcaaagggctagtgatgggcatgccttctgctggtttccctagtaactgat

SEQ ID NO: 106379 - DNA, 201 bp, Bos taurus; identical to SEQ ID NO: 25300

SEQ ID NO: 106380 - DNA, 201 bp, Bos taurus; identical to SEQ ID NO: 25302

SEQ ID NO: 106381 - DNA, 201 bp, Bos taurus; identical to SEQ ID NO: 65628

SEQ ID NO: 106382 - DNA, 201 bp, Bos taurus; identical to SEQ ID NO: 25309

SEQ ID NO: 106383 - DNA, 201 bp, Bos taurus; identical to SEQ ID NO: 25310

SEQ ID NO: 106384 - DNA, 201 bp, Bos taurus; identical to SEQ ID NO: 25311

SEQ ID NO: 106385 - DNA, 201 bp, Bos taurus; identical to SEQ ID NO: 25312

SEQ ID NO: 106386 - DNA, 201 bp, Bos taurus; identical to SEQ ID NO: 25313

SEQ ID NO: 106387 - DNA, 201 bp, Bos taurus
ctcagcttggcgctagaactgagaaagtgaggtctgtctctctctgggaggttgaagataggagaggtgagtttgtgacctgctactggcctcattcttctacacggaccaaggagcacaggaagaagtctgcagtatgaagaaacacataaccaatgcagatacggcttccgagaatgtgcctgggagccacggcctgga

SEQ ID NO: 106388 - DNA, 201 bp, Bos taurus
cagccagcaacccccaccattagcaagtctgctcggaaggacaggaggcctgggcagcagctgctgcagcccagctacccaagtggggcatctgctctgtcatctacaagctgtgtgaccttggccagctatttaaccttgtggagtctgttttctcatttgagtagtaatattttcatgatgctggggtggcagggatga

SEQ ID NO: 106389 - DNA, 201 bp, Bos taurus
tgaagtgacacgggagcttgggaacaaagccaaagaatagcagttcagattttagcgtgggacttcaaagcatgttgaagtgaggactgtgacaggtcctaccctccatggcctaagggttctctaaggaaagaggagagactgggaccacggctcgtcaggctacagaacagacatgccaagaaggatccagaaaccctg

SEQ ID NO: 106390 - DNA, 201 bp, Bos taurus
atcattaataaacatcttttcttttttcttctcttccaaagaaatatgttgaagttatgacccaatggtattgatttgatatggagtaaaaacttcacacaacagcacaacacttagaataagataaagcagtgttctacgttgaacagcacagagactcaaaatttccttgtaaaaagtattttaataatgacagtctac

SEQ ID NO: 106391 - DNA, 201 bp, Bos taurus
gactaaatagcaacaacaaaaattacgtttctctctcttcctgtgctgcttttatgacttctttccttttttctttgacttttaacagttttattatgatatgtctggttatagttttctttgtagttgttttgcttgaagtttttagagctcttcaaatctgtgacttactgtctttcaccaattttggaaaattctcag

SEQ ID NO: 106392 - DNA, 201 bp, Bos taurus; identical to SEQ ID NO: 25315

SEQ ID NO: 106393 - DNA, 201 bp, Bos taurus; identical to SEQ ID NO: 25316

SEQ ID NO: 106394 - DNA, 201 bp, Bos taurus; identical to SEQ ID NO: 25317

SEQ ID NO: 106395 - DNA, 201 bp, Bos taurus; identical to SEQ ID NO: 25318

SEQ ID NO: 106396 - DNA, 201 bp, Bos taurus
cacctactgatgggatgcacagggccttgtggaaaaaaaaaaaaaaacaaaacacagtgtctagcagctcaggaaagaagtgtttacattatgacagcagatgaggccaggaagggcttcccagaggaggtaatattctagctgggttttgtaggataaatagaaattggctagtaggggtgggaagtgctctctagggag

SEQ ID NO: 106397 - DNA, 201 bp, Bos taurus; identical to SEQ ID NO: 25319

SEQ ID NO: 106398 - DNA, 201 bp, Bos taurus; identical to SEQ ID NO: 25320

SEQ ID NO: 106399 - DNA, 201 bp, Bos taurus; identical to SEQ ID NO: 25322

SEQ ID NO: 106400 - DNA, 201 bp, Bos taurus; identical to SEQ ID NO: 25323

SEQ ID NO: 106401 - DNA, 201 bp, Bos taurus; identical to SEQ ID NO: 25324

SEQ ID NO: 106402 - DNA, 201 bp, Bos taurus; identical to SEQ ID NO: 25325

SEQ ID NO: 106403 - DNA, 201 bp, Bos taurus; identical to SEQ ID NO: 25327

SEQ ID NO: 106404 - DNA, 201 bp, Bos taurus; identical to SEQ ID NO: 25329

SEQ ID NO: 106405 - DNA, 201 bp, Bos taurus
tcacaggtgggatcttacttccctgaccggggattgaacctgcatcgcctgtattggaagcactggagtcactgggccaccagggaagtccctcattcttctctaactaacccaagttctcctcagcctgcaaaaggcaattcagaccccacttctcccatgtcgcttcccttggccactttatcccaccctggcgggata

SEQ ID NO: 106406 - DNA, 201 bp, Bos taurus; identical to SEQ ID NO: 25331

SEQ ID NO: 106407 - DNA, 201 bp, Bos taurus; identical to SEQ ID NO: 25332

SEQ ID NO: 106408 - DNA, 201 bp, Bos taurus; identical to SEQ ID NO: 25333

SEQ ID NO: 106409 - DNA, 201 bp, Bos taurus; identical to SEQ ID NO: 25334

SEQ ID NO: 106410 - DNA, 201 bp, Bos taurus; identical to SEQ ID NO: 25335

SEQ ID NO: 106411 - DNA, 201 bp, Bos taurus; identical to SEQ ID NO: 25336

SEQ ID NO: 106412 - DNA, 201 bp, Bos taurus; identical to SEQ ID NO: 25337

SEQ ID NO: 106413 - DNA, 201 bp, Bos taurus; identical to SEQ ID NO: 25338

SEQ ID NO: 106414 - DNA, 201 bp, Bos taurus; identical to SEQ ID NO: 25339

SEQ ID NO: 106415 - DNA, 201 bp, Bos taurus; identical to SEQ ID NO: 25340

SEQ ID NO: 106416 - DNA, 201 bp, Bos taurus; identical to SEQ ID NO: 25341

SEQ ID NO: 106417 - DNA, 201 bp, Bos taurus; identical to SEQ ID NO: 25342

SEQ ID NO: 106418 - DNA, 201 bp, Bos taurus; identical to SEQ ID NO: 25343

SEQ ID NO: 106419 - DNA, 201 bp, Bos taurus; identical to SEQ ID NO: 25344

SEQ ID NO: 106420 - DNA, 201 bp, Bos taurus; identical to SEQ ID NO: 25345

SEQ ID NO: 106421 - DNA, 201 bp, Bos taurus
ctggtacaatcagtcccattgagtgatgagtcatgtagggtgcttgttcttagtaaatccaaatacaaacagacccatggggctttctgctatgtgctcacgcacagtgctgaccagaaaactgattttacaagactatcagttcctaatggatatgtcataatgtcttggaagagcatattcaggaagtttacagcgact

SEQ ID NO: 106422 - DNA, 201 bp, Bos taurus; identical to SEQ ID NO: 25348

SEQ ID NO: 106423 - DNA, 201 bp, Bos taurus
gtccgtctgtggtggggttggaataggatcagtgggtgatttggattctcagttccaagagtgaccactacctgtggcctcagccattgaaaatgcagatgctggtgccttaagtgtttcctcctcctcaatgagactcattccctaggatgatcaaaaggcagaaaatgatatggccatgaaacgagcagctttgttgga

SEQ ID NO: 106424 - DNA, 201 bp, Bos taurus; identical to SEQ ID NO: 25349

SEQ ID NO: 106425 - DNA, 201 bp, Bos taurus; identical to SEQ ID NO: 25350

SEQ ID NO: 106426 - DNA, 201 bp, Bos taurus; identical to SEQ ID NO: 25351

SEQ ID NO: 106427 - DNA, 201 bp, Bos taurus; identical to SEQ ID NO: 25353

SEQ ID NO: 106428 - DNA, 201 bp, Bos taurus; identical to SEQ ID NO: 25354

SEQ ID NO: 106429 - DNA, 201 bp, Bos taurus
ttgaaaatttttgcatcaatgtttatcaaagatattggcctgtgattttccttattgtagtgcctttgtctgtttttggtatgagggtaatgatggccccgtacaatgaatttgggagtgtttcatcttcaatatttttgggacagtttgagaatatttcataacttgatagcagttggatgcatgcacttgggtgtttta

SEQ ID NO: 106430 - DNA, 201 bp, Bos taurus; identical to SEQ ID NO: 25358

SEQ ID NO: 106431 - DNA, 201 bp, Bos taurus; identical to SEQ ID NO: 25364

SEQ ID NO: 106432 - DNA, 201 bp, Bos taurus
cgtttgagaaagataaggaatgtaacatttgttccttgatggtaataactcaaaacgctcccctcccttccttcataacactaattccatccatggggccatgataagtcactggaggctctcaggaggttcatcacccacacgatttgatacaaaaacatctgtgctgatgcacacagctttgtatcattacagatgata

SEQ ID NO: 106433 - DNA, 201 bp, Bos taurus
accaggatgagtaacacacataacggcactgaagactcttaccaggatgggaaagcccaattaccattattttataattaaatactggagacgcatcagtttaacttccaggtaggttttaaaaatagtaatcatactggtatataattcacaacaatcactatttattttcttctaaactttaagatacataaataatac

SEQ ID NO: 106434 - DNA, 201 bp, Bos taurus; identical to SEQ ID NO: 25366

SEQ ID NO: 106435 - DNA, 201 bp, Bos taurus
cactgactgcggctcccgcatttacacatttacgagctgggagtctcgtcagggtgaaccaataaaatcgtccttgtggctccgttgggcccacggtctttcctggactgcttttcccatgaaatgtcagctctcatcagaaaacaaaggaagccagagtgtgagcgggaggggaactaagacaccatctggtggccattc

SEQ ID NO: 106436 - DNA, 201 bp, Bos taurus; identical to SEQ ID NO: 25367

SEQ ID NO: 106437 - DNA, 201 bp, Bos taurus; identical to SEQ ID NO: 25369

SEQ ID NO: 106438 - DNA, 201 bp, Bos taurus; identical to SEQ ID NO: 25372

SEQ ID NO: 106439 - DNA, 201 bp, Bos taurus; identical to SEQ ID NO: 25373

SEQ ID NO: 106440 - DNA, 201 bp, Bos taurus; identical to SEQ ID NO: 25374

SEQ ID NO: 106441 - DNA, 201 bp, Bos taurus
tacaacatgccatacagaatgcaaaatttacatgattgttttgtcataacagtgttcgtgttctgcattttggtggttttgagcataggagaaaattagacacatgataaaatgtgtaatttgtattattggtaaaggcagttatactctttaaatgttccacatttcaggtattgatgaaccattgcacatcaagagaag

SEQ ID NO: 106442 - DNA, 201 bp, Bos taurus; identical to SEQ ID NO: 25375

SEQ ID NO: 106443 - DNA, 201 bp, Bos taurus
tccgctcctcctgggatcctagcacctcttctccccactctgaactctacagaaccaaatatctcacgggccttttaaaaatggggccaggggagcagagtgggtgtctcctgtgttgtcttagcatcatttgtcagaagattcaacagactcaactaagaatgccggcccagcaagctacaaactaattgagaaatcaga

SEQ ID NO: 106444 - DNA, 201 bp, Bos taurus; identical to SEQ ID NO: 25378

SEQ ID NO: 106445 - DNA, 201 bp, Bos taurus; identical to SEQ ID NO: 25379

SEQ ID NO: 106446 - DNA, 201 bp, Bos taurus
agctgatgcacaatattacataagttacaggtgtataatgagtcataatttttaaaggttatcctccagttacagttacttaaaacattgtctgtattccttgtgctgtacatccctgtagctcacttcacatgtaacagtctgtatatctcaccccactgccctagagagtccctcacccttctctctccccactaataa

SEQ ID NO: 106447 - DNA, 201 bp, Bos taurus
cccatgctttcttccataaaatatttttaaaatttctgtttaacatagatcaattttgcttaacacttgagatactgttctaaatagccttttctttccctactccagatggccacctggttatccgaccactatttattgaacagagcatctttctccaattaacttgaaacgccatcttttgtcatatactaaacatga

SEQ ID NO: 106448 - DNA, 201 bp, Bos taurus
aacttcagagatatttctgttttccactgatttaagcattctttggactccttttatcttcagcaaaaagctccacgtatgttctgtgaagagccgtaccgaggtcatcctagatatgatacaggtatatgtttatcatttagttgcagtgtatgtgtttattccaaggccggtgggaatggcattttgtaacttgttttt

SEQ ID NO: 106449 - DNA, 201 bp, Bos taurus; identical to SEQ ID NO: 25383

SEQ ID NO: 106450 - DNA, 201 bp, Bos taurus; identical to SEQ ID NO: 25384

SEQ ID NO: 106451 - DNA, 201 bp, Bos taurus
tatttaaatggtattttctgggtttctccttgggaagaggtactgtgaaactgttatcatcttcatcaaatgatttcaatacattcaatatatggccttaagatttcctgttttatagaatgaattatcctgttcagttgtgtttatcttgatactgaaattgtctcttatttggccagtgggatttccttccagttggct

SEQ ID NO: 106452 - DNA, 201 bp, Bos taurus; identical to SEQ ID NO: 25385

SEQ ID NO: 106453 - DNA, 201 bp, Bos taurus
tctttgattcagtaggggaataactattaatgagtatgaactgtagctccatttcactgtagaagacacgccagatggttggaagtgcactttagaagggacagagtcagaagtactatgggctaaacaaaggctatttggagatggggtgtgtatggaagaaaccaagagtatggctgggtaaggaagaagatgactgct

SEQ ID NO: 106454 - DNA, 201 bp, Bos taurus
actccactatattttgatgctaaatatccagcaagtcaagctgatagaggattaattcattgtcttcaataactgaagaagaagacgtatcataatttttcattattttcttaatgacgtacattggatttggtagtctcgtctaccatttttgtttatatcactgtgaacaatgtggctctctttatttttggtaaataa

SEQ ID NO: 106455 - DNA, 201 bp, Bos taurus; identical to SEQ ID NO: 25386

SEQ ID NO: 106456 - DNA, 201 bp, Bos taurus
ccattgtccctgggcaattcttgctacttcctcaacgttgactaggaagataaatagtagacaaatcatttatttaataaaaccaaatctagggtaatgtatcctctggaaaagattaaccccctcaccctctttccttccttttgcctctcattaattgcctctaattactcaattgcatctaattattgccttctccag

SEQ ID NO: 106457 - DNA, 201 bp, Bos taurus; identical to SEQ ID NO: 25387

SEQ ID NO: 106458 - DNA, 201 bp, Bos taurus; identical to SEQ ID NO: 25388

SEQ ID NO: 106459 - DNA, 201 bp, Bos taurus
atattggaaaacaacttctgaagaaaaaaagaaaacctttctgcttaccatggttatatctcagtaactgtgactctcaaacattttaaccctaatgggcgcatgtgtgagtgtgaaagtcagactgctgtcccctgcaccctggagagccaggggttgtgagtgtctccccacgaagcctcttgtgacaccatctgcccc

SEQ ID NO: 106460 - DNA, 201 bp, Bos taurus
gcatgttatgtttatcagaagatttccaactacaaaacttccttgctggctgggaagaagggaagctacatttgacaagaagaggcaaggggaaggcccataactgcactgaacaaaataattccagggaatgccagcctctaaggggatgggtgcagttattttctacaagtgtcaagctgcttacttttgacccgcaga

SEQ ID NO: 106461 - DNA, 201 bp, Bos taurus
caatagaaatcttcaatcactcactcttcctcacaaaataaaatttgctttaggctttcaatgagggccaattgaaaaattaatcataaaattgctagagcggtgacaaagctgctttgcaatgtttttaaatatttaattgactcttctttgcgatcagcatcaagtcctaaatgtgtggtcgaaaaaggaaaaatctaa

SEQ ID NO: 106462 - DNA, 201 bp, Bos taurus
tcaaatggccttttttgtagactgtacatcctttctttaaaggacattagtcatatctgagtaggacttcaccactgtcatctcatttaacctttgctgagaaggcacaggagggcctagaggagctatcccacattgaagatcaggaagggcggcagtgaggagatacccctcatccaaggtaaggagcaatggctgcgc

SEQ ID NO: 106463 - DNA, 201 bp, Bos taurus
gtctcattcaattgagttgttaatcttccttaattgcaaatttggaccttatggggatcactcattattgcagtggacatttgtcattttcctgagactcaagtatatggggaattccatatcttatgagtcttggtaagagataagctggactccctttagagaagtggattgtctcattatcttacagacattctagtt

SEQ ID NO: 106464 - DNA, 201 bp, Bos taurus; identical to SEQ ID NO: 25389

SEQ ID NO: 106465 - DNA, 201 bp, Bos taurus; identical to SEQ ID NO: 25390

SEQ ID NO: 106466 - DNA, 201 bp, Bos taurus; identical to SEQ ID NO: 25391

SEQ ID NO: 106467 - DNA, 201 bp, Bos taurus
atatcagcaggggttaggtttaagtacacacacaaaaatagcagtttaaataaggttgctttcatgcaaaagaatctcgagggtggccatctggagagattatgttggttgtacttggttatcaaagacttgtggtcctcccaactcttccttctaccactagggagagtttcaggagctccatgagcagctcagctagta

SEQ ID NO: 106468 - DNA, 201 bp, Bos taurus
agtttaatcatgggtggttgagactgaaagaagaggaagagtagaaagtagcagcctgagagaacaagagcgaaaaagtgaagcagccggcccagattcaaatcttcaagtctcctgtctgctctcgagccattggctggtaaccagcagccctgtggtgaatggaggggtgaggccaagttgactgaggagccacttgtt

SEQ ID NO: 106469 - DNA, 201 bp, Bos taurus
tttcttcagctgtaaaatgggaataatacccatcttactatatgggaatttttgaagcatgtgaaataacacaaccacaaggtaacaagcaccaaacaaatgttcattgttttgcttccacttttccagattgggtttgcatttccccaaaccatgtctctcggagaaggcaatggcaccccactccagtactcttgcctg

SEQ ID NO: 106470 - DNA, 201 bp, Bos taurus; identical to SEQ ID NO: 25392

SEQ ID NO: 106471 - DNA, 201 bp, Bos taurus; identical to SEQ ID NO: 25393

SEQ ID NO: 106472 - DNA, 201 bp, Bos taurus; identical to SEQ ID NO: 25394

SEQ ID NO: 106473 - DNA, 201 bp, Bos taurus; identical to SEQ ID NO: 25395

SEQ ID NO: 106474 - DNA, 201 bp, Bos taurus; identical to SEQ ID NO: 25396

SEQ ID NO: 106475 - DNA, 201 bp, Bos taurus; identical to SEQ ID NO: 25397

SEQ ID NO: 106476 - DNA, 201 bp, Bos taurus; identical to SEQ ID NO: 25398

SEQ ID NO: 106477 - DNA, 201 bp, Bos taurus; identical to SEQ ID NO: 25399

SEQ ID NO: 106478 - DNA, 201 bp, Bos taurus; identical to SEQ ID NO: 25400

SEQ ID NO: 106479 - DNA, 201 bp, Bos taurus; identical to SEQ ID NO: 25401

SEQ ID NO: 106480 - DNA, 201 bp, Bos taurus; identical to SEQ ID NO: 25402

SEQ ID NO: 106481 - DNA, 201 bp, Bos taurus; identical to SEQ ID NO: 25403

SEQ ID NO: 106482 - DNA, 201 bp, Bos taurus; identical to SEQ ID NO: 25404

SEQ ID NO: 106483 - DNA, 201 bp, Bos taurus; identical to SEQ ID NO: 25405

SEQ ID NO: 106484 - DNA, 201 bp, Bos taurus; identical to SEQ ID NO: 25406

SEQ ID NO: 106485 - DNA, 201 bp, Bos taurus; identical to SEQ ID NO: 25407

SEQ ID NO: 106486 - DNA, 201 bp, Bos taurus; identical to SEQ ID NO: 25408

SEQ ID NO: 106487 - DNA, 201 bp, Bos taurus; identical to SEQ ID NO: 25409

SEQ ID NO: 106488 - DNA, 201 bp, Bos taurus; identical to SEQ ID NO: 25414

SEQ ID NO: 106489 - DNA, 201 bp, Bos taurus; identical to SEQ ID NO: 25416

SEQ ID NO: 106490 - DNA, 201 bp, Bos taurus; identical to SEQ ID NO: 25418

SEQ ID NO: 106491 - DNA, 201 bp, Bos taurus; identical to SEQ ID NO: 25426

SEQ ID NO: 106492 - DNA, 201 bp, Bos taurus; identical to SEQ ID NO: 25427

SEQ ID NO: 106493 - DNA, 201 bp, Bos taurus; identical to SEQ ID NO: 25428

SEQ ID NO: 106494 - DNA, 201 bp, Bos taurus; identical to SEQ ID NO: 25430

SEQ ID NO: 106495 - DNA, 201 bp, Bos taurus; identical to SEQ ID NO: 25442

SEQ ID NO: 106496 - DNA, 201 bp, Bos taurus
aagccttcttttcagcttcaactctcacgtggccacctctttcattgctggtaggttcctgctgccaagggtgggcgacggtgggtgcccttgctaggacttcttatttaaacaaggccactttccagcctattttgcatgcaaatgcttacaagagcatgccagcttgctccttaaaattagatgaaataaagacacttg

SEQ ID NO: 106497 - DNA, 201 bp, Bos taurus
gtcgaggtctcactctcctcttttgttctcccttgtctcacagcaccctggagggatattatgtggacgatgccctgcagggccagggagtttacacttatgaggatggaggagttctccagggcacatatgtagacggagagctgaatggaccggcccaggagtacgacacagacgggaggctgatcttcaagggacaat

SEQ ID NO: 106498 - DNA, 201 bp, Bos taurus; identical to SEQ ID NO: 25443

SEQ ID NO: 106499 - DNA, 201 bp, Bos taurus; identical to SEQ ID NO: 25444

SEQ ID NO: 106500 - DNA, 201 bp, Bos taurus; identical to SEQ ID NO: 25445

SEQ ID NO: 106501 - DNA, 201 bp, Bos taurus; identical to SEQ ID NO: 25446

SEQ ID NO: 106502 - DNA, 201 bp, Bos taurus
gaagtcctaaccaggatctcaccgtgtgactgtatttggagatagagcttttaaagaagtaattaaggttaaatgagatcatacggatgggccctaactggtatccttataagaagcagaaattaggatgcacacatacacacacgcacacacacacacacacacacacacacacacacacagggaggcccatgtgaagac

SEQ ID NO: 106503 - DNA, 201 bp, Bos taurus; identical to SEQ ID NO: 25447

SEQ ID NO: 106504 - DNA, 201 bp, Bos taurus; identical to SEQ ID NO: 25448

SEQ ID NO: 106505 - DNA, 201 bp, Bos taurus; identical to SEQ ID NO: 25452

SEQ ID NO: 106506 - DNA, 201 bp, Bos taurus
tttttaagaataccatctaaaggacaaaacagtgataattttttcttgttacaaggaccgtaatagttttccacaagataatgcacttcaatgggtactgatatctttccttaaagtttcattgttttgaaaaaaaaaggaagaattcaaaactgggacagcctttttcatttaataactaagaaacaagtaaatattcct

SEQ ID NO: 106507 - DNA, 201 bp, Bos taurus; identical to SEQ ID NO: 25453

SEQ ID NO: 106508 - DNA, 201 bp, Bos taurus
aggttaaggaaggaaaaaaatagacaatatagatgcaacttggcccttgacaacataggcaatgtgtcattttatatagcttaaacctaatcattgttgcgaaagaaaaatttcagagttgtcatggcattaaagtgactttcataagcattagagcattgaaacatattaaagaagatttatgtctttttattcaatgct

SEQ ID NO: 106509 - DNA, 201 bp, Bos taurus; identical to SEQ ID NO: 25455

SEQ ID NO: 106510 - DNA, 201 bp, Bos taurus; identical to SEQ ID NO: 25456

SEQ ID NO: 106511 - DNA, 201 bp, Bos taurus
tctttttcttacttacttcactctgtataataaagcctgttgctcttatcaatgactttatttgctgaatgaattcaaaactattagatggcctcatactgcctaatggtccttgtttctcacagttgttctctctatattcattcagttcagttcagtcgctcagtcatgtgcgactctttgcgaccccatgaatcgcag

SEQ ID NO: 106512 - DNA, 201 bp, Bos taurus; identical to SEQ ID NO: 25458

SEQ ID NO: 106513 - DNA, 201 bp, Bos taurus; identical to SEQ ID NO: 25459

SEQ ID NO: 106514 - DNA, 201 bp, Bos taurus
tttttatgttttagaggatggggccaagataagcactcatataggaaggggcttgcttgtattatttgaatatacgacttaagctagagaaatagcccccaggccctttcatcagctttatatatgtgggacacaggaagaagagctaaaggtaaggtttaaagatgacagtgtcaaacataaaaaaatagaatcagcata

SEQ ID NO: 106515 - DNA, 201 bp, Bos taurus; identical to SEQ ID NO: 25460

SEQ ID NO: 106516 - DNA, 201 bp, Bos taurus; identical to SEQ ID NO: 25461

SEQ ID NO: 106517 - DNA, 201 bp, Bos taurus; identical to SEQ ID NO: 25463

SEQ ID NO: 106518 - DNA, 201 bp, Bos taurus; identical to SEQ ID NO: 25464

SEQ ID NO: 106519 - DNA, 201 bp, Bos taurus
cttgagctgagatgcctaaagaagatcttggctgacaaccttagataaataatctaggaatgtaggtccttgaggcagtaatgcaaactacatgaatatggtggccagagagccctgaatccttgcctgcagcccatccagaaactgaatgttgtgcatcaggtggagtgtgggtagggcagctttctcccacgtgtcctg

SEQ ID NO: 106520 - DNA, 201 bp, Bos taurus
gcttaatcacttaagaaaatgccaaatcactttttaaaaaagactctggagcctaaattatgattttgaatatttcattgatacatacagctaaacactgtaatactgtatacaccataatgcaaaacagatgcagaaaaacacatttttaatcttactgacaaagacagctacaatagcaaatcacttacatagtatgta

SEQ ID NO: 106521 - DNA, 201 bp, Bos taurus; identical to SEQ ID NO: 25466

SEQ ID NO: 106522 - DNA, 201 bp, Bos taurus; identical to SEQ ID NO: 25467

SEQ ID NO: 106523 - DNA, 201 bp, Bos taurus; identical to SEQ ID NO: 25468

SEQ ID NO: 106524 - DNA, 201 bp, Bos taurus; identical to SEQ ID NO: 25469

SEQ ID NO: 106525 - DNA, 201 bp, Bos taurus; identical to SEQ ID NO: 25470

SEQ ID NO: 106526 - DNA, 201 bp, Bos taurus; identical to SEQ ID NO: 25471

SEQ ID NO: 106527 - DNA, 201 bp, Bos taurus; identical to SEQ ID NO: 25472

SEQ ID NO: 106528 - DNA, 201 bp, Bos taurus; identical to SEQ ID NO: 25479

SEQ ID NO: 106529 - DNA, 201 bp, Bos taurus; identical to SEQ ID NO: 25480

SEQ ID NO: 106530 - DNA, 201 bp, Bos taurus; identical to SEQ ID NO: 25484

SEQ ID NO: 106531 - DNA, 201 bp, Bos taurus; identical to SEQ ID NO: 25488

SEQ ID NO: 106532 - DNA, 201 bp, Bos taurus; identical to SEQ ID NO: 25489

SEQ ID NO: 106533 - DNA, 201 bp, Bos taurus; identical to SEQ ID NO: 25490

SEQ ID NO: 106534 - DNA, 201 bp, Bos taurus; identical to SEQ ID NO: 25492

SEQ ID NO: 106535 - DNA, 201 bp, Bos taurus; identical to SEQ ID NO: 25494

SEQ ID NO: 106536 - DNA, 201 bp, Bos taurus; identical to SEQ ID NO: 25497

SEQ ID NO: 106537 - DNA, 201 bp, Bos taurus; identical to SEQ ID NO: 25498

SEQ ID NO: 106538 - DNA, 201 bp, Bos taurus; identical to SEQ ID NO: 25499

SEQ ID NO: 106539 - DNA, 201 bp, Bos taurus; identical to SEQ ID NO: 25502

SEQ ID NO: 106540 - DNA, 201 bp, Bos taurus; identical to SEQ ID NO: 25503

SEQ ID NO: 106541 - DNA, 201 bp, Bos taurus; identical to SEQ ID NO: 25508

SEQ ID NO: 106542 - DNA, 201 bp, Bos taurus; identical to SEQ ID NO: 25509

SEQ ID NO: 106543 - DNA, 201 bp, Bos taurus; identical to SEQ ID NO: 25510

SEQ ID NO: 106544 - DNA, 201 bp, Bos taurus; identical to SEQ ID NO: 25513

SEQ ID NO: 106545 - DNA, 201 bp, Bos taurus; identical to SEQ ID NO: 25515

SEQ ID NO: 106546 - DNA, 201 bp, Bos taurus; identical to SEQ ID NO: 25516

SEQ ID NO: 106547 - DNA, 201 bp, Bos taurus; identical to SEQ ID NO: 25519

SEQ ID NO: 106548 - DNA, 201 bp, Bos taurus; identical to SEQ ID NO: 25520

SEQ ID NO: 106549 - DNA, 201 bp, Bos taurus; identical to SEQ ID NO: 25522

SEQ ID NO: 106550 - DNA, 201 bp, Bos taurus; identical to SEQ ID NO: 25523

SEQ ID NO: 106551 - DNA, 201 bp, Bos taurus; identical to SEQ ID NO: 25529

SEQ ID NO: 106552 - DNA, 201 bp, Bos taurus; identical to SEQ ID NO: 25532

SEQ ID NO: 106553 - DNA, 201 bp, Bos taurus; identical to SEQ ID NO: 25533

SEQ ID NO: 106554 - DNA, 201 bp, Bos taurus; identical to SEQ ID NO: 25534

SEQ ID NO: 106555 - DNA, 201 bp, Bos taurus; identical to SEQ ID NO: 25535

SEQ ID NO: 106556 - DNA, 201 bp, Bos taurus; identical to SEQ ID NO: 25536

SEQ ID NO: 106557 - DNA, 201 bp, Bos taurus; identical to SEQ ID NO: 25537

SEQ ID NO: 106558 - DNA, 201 bp, Bos taurus; identical to SEQ ID NO: 25538

SEQ ID NO: 106559 - DNA, 201 bp, Bos taurus; identical to SEQ ID NO: 25539

SEQ ID NO: 106560 - DNA, 201 bp, Bos taurus; identical to SEQ ID NO: 25540

SEQ ID NO: 106561 - DNA, 201 bp, Bos taurus; identical to SEQ ID NO: 25542

SEQ ID NO: 106562 - DNA, 201 bp, Bos taurus; identical to SEQ ID NO: 25543

SEQ ID NO: 106563 - DNA, 201 bp, Bos taurus; identical to SEQ ID NO: 25544

SEQ ID NO: 106564 - DNA, 201 bp, Bos taurus; identical to SEQ ID NO: 25545

SEQ ID NO: 106565 - DNA, 201 bp, Bos taurus; identical to SEQ ID NO: 25547

SEQ ID NO: 106566 - DNA, 201 bp, Bos taurus; identical to SEQ ID NO: 25548

SEQ ID NO: 106567 - DNA, 201 bp, Bos taurus; identical to SEQ ID NO: 25549

SEQ ID NO: 106568 - DNA, 201 bp, Bos taurus; identical to SEQ ID NO: 25552

SEQ ID NO: 106569 - DNA, 201 bp, Bos taurus; identical to SEQ ID NO: 25554

SEQ ID NO: 106570 - DNA, 201 bp, Bos taurus; identical to SEQ ID NO: 25555

SEQ ID NO: 106571 - DNA, 201 bp, Bos taurus; identical to SEQ ID NO: 25557

SEQ ID NO: 106572 - DNA, 201 bp, Bos taurus; identical to SEQ ID NO: 25558

SEQ ID NO: 106573 - DNA, 201 bp, Bos taurus; identical to SEQ ID NO: 25559

SEQ ID NO: 106574 - DNA, 201 bp, Bos taurus; identical to SEQ ID NO: 25560

SEQ ID NO: 106575 - DNA, 201 bp, Bos taurus; identical to SEQ ID NO: 25562

SEQ ID NO: 106576 - DNA, 201 bp, Bos taurus; identical to SEQ ID NO: 25564

SEQ ID NO: 106577 - DNA, 201 bp, Bos taurus; identical to SEQ ID NO: 25565

SEQ ID NO: 106578 - DNA, 201 bp, Bos taurus; identical to SEQ ID NO: 25572

SEQ ID NO: 106579 - DNA, 201 bp, Bos taurus; identical to SEQ ID NO: 25573

SEQ ID NO: 106580 - DNA, 201 bp, Bos taurus; identical to SEQ ID NO: 25575

SEQ ID NO: 106581 - DNA, 201 bp, Bos taurus
ttggccactcctgaaccaatcactagtaaagaggaaaaagcaatcatgattggctcagatctatagtctggtaaagaacaaatactggagaaccaatcactatgtccattacacgatttcacttgatcatcacactcactcacttggttacataggagagacataaaccacacagagaatagtttctcacagagaaagagg

SEQ ID NO: 106582 - DNA, 201 bp, Bos taurus
atgaactgtttatgatcctctttgctagcaagaatggaaaataacaaattcctcagatcagaagccatacacagagcacctgttattctactctagcaaaggcaatcacatctggacgagcagctgcaacttggatgacgacgtggtggactttccagtagtcggcttcatcttccctccaggcagcagccagccagccct

SEQ ID NO: 106583 - DNA, 201 bp, Bos taurus; identical to SEQ ID NO: 25576

SEQ ID NO: 106584 - DNA, 201 bp, Bos taurus
ttttcaggattttgtcattaaggaaactgacggctagcactggtacaaagaaacagaaaaataaagttggaaaacaagcataaggaggcaaattaaacttcatcgacagtctcctatgaagcatcaaaatgatgtagccgactggaataccaaagaagacccagagcatttttagtctgaaattatgcattttgtgcacaa

SEQ ID NO: 106585 - DNA, 201 bp, Bos taurus
tttcagtggctgatactagaaggggtgagcccagacccctctagcacatggatccacatacctaacatggcacacatcaagatgtgggcctgtgttttagaagtagatctcaaggcaggctggtgtcttcagcagttgagccctgcctttgaacttgcctgggggccatttaggtcccaggctcttccaggcaatagcctt

SEQ ID NO: 106586 - DNA, 201 bp, Bos taurus; identical to SEQ ID NO: 25577

SEQ ID NO: 106587 - DNA, 201 bp, Bos taurus; identical to SEQ ID NO: 25578

SEQ ID NO: 106588 - DNA, 201 bp, Bos taurus; identical to SEQ ID NO: 25579

SEQ ID NO: 106589 - DNA, 201 bp, Bos taurus; identical to SEQ ID NO: 25581

SEQ ID NO: 106590 - DNA, 201 bp, Bos taurus
tttttagaatcattcaatctaacttttattcttgggaaaatgaagatgtataaaaataatgaaaactgaaactgcattttataatttagtcaatcaggtggtaagattagggatgaaaataggtgaattacagagaatttctgggtcactttgctgtaccctgagttgaaaacacttctccttgggttaacttggttccct

SEQ ID NO: 106591 - DNA, 201 bp, Bos taurus; identical to SEQ ID NO: 25582

SEQ ID NO: 106592 - DNA, 201 bp, Bos taurus; identical to SEQ ID NO: 25583

SEQ ID NO: 106593 - DNA, 201 bp, Bos taurus; identical to SEQ ID NO: 25584

SEQ ID NO: 106594 - DNA, 201 bp, Bos taurus; identical to SEQ ID NO: 25585

SEQ ID NO: 106595 - DNA, 201 bp, Bos taurus; identical to SEQ ID NO: 25586

SEQ ID NO: 106596 - DNA, 201 bp, Bos taurus; identical to SEQ ID NO: 25588

SEQ ID NO: 106597 - DNA, 201 bp, Bos taurus; identical to SEQ ID NO: 25591

SEQ ID NO: 106598 - DNA, 201 bp, Bos taurus; identical to SEQ ID NO: 25592

SEQ ID NO: 106599 - DNA, 201 bp, Bos taurus; identical to SEQ ID NO: 25594

SEQ ID NO: 106600 - DNA, 201 bp, Bos taurus
aaacaacactttgtgcaaatgattcttctgaagctatgcttcttcccctgacttgagaggaaccgtgatggtggtcttatgggacagccaccaaagatatcgcccctccgatacaggcatgcccagagaacagggctgccttcctgccagcctcctgtcgtttacactcacaacacactgtcttcacatctttcattcact

SEQ ID NO: 106601 - DNA, 201 bp, Bos taurus
tggttagtctttcctttcttcggtccatccagccaatatttgcgtcagagaggcacctgaagctggggatccagcagtacccacgacagacaaaccccactctctgggaacttctgtatggcaagttagagtatgaaagtaaaccagggaataaacaaagtaagctccagttctgacaagggttatggaaacatagaacag

SEQ ID NO: 106602 - DNA, 201 bp, Bos taurus
cttgacttttctgagaatttgctgaattttccactttgcctttattttttgcttttagcagggtcactgagttactgttggcatacaatgaaaggggtgcatgcatatgtggtcagccttgtctgactctttgtgatctcatggactgtagtctgccagactcctctgtccatgggattctctaggcaagaatactggagt

SEQ ID NO: 106603 - DNA, 201 bp, Bos taurus
agtggcaactggaaaggtgaccacagcttagtgagggcgccagcaacagacctagagcctggatccaaagagtctcagataaggaaatggagacatgagaaatgacttcacatgtgtgatagctcctataacagaaaagagacgggagtttaggattaggtggtgtggcttttattcccagccccactgcaaaaatattaa

SEQ ID NO: 106604 - DNA, 201 bp, Bos taurus
ctaaggaggtatcccacatcagaggtttgtctccctttgcctggcctgtcttcttaattccccagctatgcttaccctggcattggatgtttcccttattactcagacttgtttgctttggcctggattttccttaattatccaagtgtctgcactgacctggaatgtcccccttatttcccaggtgtatctactttgacc

SEQ ID NO: 106605 - DNA, 201 bp, Bos taurus
atttttgacctggtgtttatggggttcctctgagctgggtcacaccctgcaagtggcctgcttacccccgcccctcacatgcaccgtgtgccactccaagccctttagattgactatttgagcgaattccctgctctaagtctcccctgttcctatacacagagagaaaggagtggggctagactggacttcagcgtgagc

SEQ ID NO: 106606 - DNA, 201 bp, Bos taurus; identical to SEQ ID NO: 25602

SEQ ID NO: 106607 - DNA, 201 bp, Bos taurus
aggcactcgtgtgatttcacgtgtctgtaatgggcaatgagatcacaaaggcatctcaggaacaatccaagcccaggattcttttatgcatcctgtgattgactgctcatatatttaagttgtctggtccacattgactttgaaggtcattttttgggcaacctgctttgattaaatttttccaaagcatgccaagtattt

SEQ ID NO: 106608 - DNA, 201 bp, Bos taurus
tctcttatcttctatctgggcagggccctcctcccctcagttgtcctgctgttttcatcttggaccatcaatccacagaggacaaatcccaactgtttgcgctggggccccataaatctcctgcctcattgcaatgaggcgagggtggctctccccaggggtgttcaggggagggggaaacaggtggctggatgttgggtc

SEQ ID NO: 106609 - DNA, 201 bp, Bos taurus
gtgggatcttcccaggccagactttgatctcgtgtctcctgcattggcacgtggattctttactactgaaccatcagggatgcccaggattaagattcttgaagaaaagtattggcagggatgtgaaaagaaagctctctccacatttttcttggaagttgaaactggtacaatcagcttgaaaggcaatttgacctccct

SEQ ID NO: 106610 - DNA, 201 bp, Bos taurus
ggagtttaatctccaaatgatgttacatggcaacacgacctctctctaatctgtacgattagggaaaacggaaagtctgggcagctctgataaaacggcccattttgcaagtgttccaaacaagagtttctcgagaaagcaaacaaacaaacgagtaaagttggtagatttcctggcctgaaaaggtgccttttacatttg

SEQ ID NO: 106611 - DNA, 201 bp, Bos taurus
tggagaggacttataccaaaaagagtcagcctggctgagtttttgccccatttattgttgttacagctgaagtcacagcaggaagcagaagagatacagtgagagtggagagaaagttacagagagattattcatagaggtgtgggcagggagaaaggcccaataagtgactaaagcagcaggaagttcttacctccctgg

SEQ ID NO: 106612 - DNA, 201 bp, Bos taurus
atacagactgcattttctgcctaaagctcagttgactggatgaattacaattaatcccaaggacttcaattgttaacacagtgcaatgttaattgaccccctgttaaatagcaaatatttgcattgtctctagagattcatcttaacaggaaattagatcacatttgaatatggaaactgtccagggaattaactgttctt

SEQ ID NO: 106613 - DNA, 201 bp, Bos taurus; identical to SEQ ID NO: 25605

SEQ ID NO: 106614 - DNA, 201 bp, Bos taurus; identical to SEQ ID NO: 25606

SEQ ID NO: 106615 - DNA, 201 bp, Bos taurus; identical to SEQ ID NO: 25607

SEQ ID NO: 106616 - DNA, 201 bp, Bos taurus; identical to SEQ ID NO: 25608

SEQ ID NO: 106617 - DNA, 201 bp, Bos taurus
gaaagaaactctgccgacacaccagtgagtatggaagaagagtcttccccagctgaacctcagatgagaatgctcgcgtttaacgctgggatccccaactcccaggccacaggccagtatcaggccattaggcagttttgttctatgggagcctaggattaattaggaactgggccacacagcaggaggtgagtggcagac

SEQ ID NO: 106618 - DNA, 201 bp, Bos taurus
ttaatataaatgataaagtatgtccaaaaaatcagagcagggcagggggccacaggaggaggtcagatcatgtcaggcctgtgggcccacaggagaacttcggtttttgctcaagacagcaagaggcaaaggtggaggctgggagacctgtcaggaggccaagataggaccctggcttgacacggagggagttcaattctg

SEQ ID NO: 106619 - DNA, 201 bp, Bos taurus
ctattgactcaaatccatcccaccatctggaaggggcttctgcaaacagcatggggcccagatggatttgttaggagagttgtgagcagagatcagctgaaagggagggaacgacagagtgagaaagagaagcaaagtgacagacagagacagagggtgaggaagagaaacaaagtgggatccacttgccatttgcccatt

SEQ ID NO: 106620 - DNA, 201 bp, Bos taurus
caggggcaagagactaggaccagggaggaggccaagagcccaggccatggggcatctatgacagcacagatccgggcaaagtaggaagagtcagcacagccgtgatgaggggaaggggaggccttagggctctgagttcaagaaagaaagctggtgtcccagcaacgatgcctgcccgtcctccaaaccctgcaagagaac

SEQ ID NO: 106621 - DNA, 201 bp, Bos taurus; identical to SEQ ID NO: 25609

SEQ ID NO: 106622 - DNA, 201 bp, Bos taurus
actgttccttgtgagcagacattcctagccaggcagccgtcaagctactgagaggggagggtgggggcagagagctgccccgtagcattttagggcctggcgatggtcacaatgcaagaacaaatgaatgtggcacatgcctggtggcgccccttgataagggtgaggggagagctgacgctattctatttcacacagggt

SEQ ID NO: 106623 - DNA, 201 bp, Bos taurus
tgcattgcagggcagattcttaaaccactggaccaccagggaagtccatttgtctccttatatttcttcttctcctcctccttctcatgtctcacccctccctgcccctgcacccatcccctggggggtatgtctttaaataggacatgtatgtccttgtgccacaggtggtgctgggggtctgcttggaacagtggtccg

SEQ ID NO: 106624 - DNA, 201 bp, Bos taurus; identical to SEQ ID NO: 25610

SEQ ID NO: 106625 - DNA, 201 bp, Bos taurus
gagagagcaatcactgttcagcgtacagcgaaaagtgggatgcacatccatgctgactgctccgcacccaacacgggccagaaacccacggcagaaagacaagctcatggggatttccctggtccagtggctgagaatctgccttccaatgcaaggggcctgggttcgagccctggtctaggaacatcccacaagcctcgg

SEQ ID NO: 106626 - DNA, 201 bp, Bos taurus
cttgggtgagtcaggccagccacttgttttgtgaataaagttttattgacacagggccacacacacctgttgaggaattaccatggcagcttttctgttacaacagcagagttgaatagtcatgacaaaccgcaaagcttgacatattcaccatctggtcctttgtagaaaaagtctgctgaccactgagttagaggaaaa

SEQ ID NO: 106627 - DNA, 201 bp, Bos taurus; identical to SEQ ID NO: 25611

SEQ ID NO: 106628 - DNA, 201 bp, Bos taurus; identical to SEQ ID NO: 25612

SEQ ID NO: 106629 - DNA, 201 bp, Bos taurus
gggctacagtccataaggtcacaaagaatcagacataattgaagtgactgagtacacacataccctaagttacccatccagctttgcgcttgattccagaacttccaatgtggtaaccatcaggcatgtgtggctattgaggccttgaagtgtggctagttcaaactgagatgtggtgtattgtgctgtatgagtttaaag

SEQ ID NO: 106630 - DNA, 201 bp, Bos taurus; identical to SEQ ID NO: 25613

SEQ ID NO: 106631 - DNA, 201 bp, Bos taurus; identical to SEQ ID NO: 25614

SEQ ID NO: 106632 - DNA, 201 bp, Bos taurus; identical to SEQ ID NO: 25615

SEQ ID NO: 106633 - DNA, 201 bp, Bos taurus; identical to SEQ ID NO: 25616

SEQ ID NO: 106634 - DNA, 201 bp, Bos taurus
cttaaaggccacacagccagtgaatagagagctagaaattgaaccttagtttatattattttaagcaatgcgcagactatattggcaatgaaaccttaagtaagtggctggcagaaaggccagaccagtacttgatgttcagacttgctgttgagaatatactttcctgtttgtatgcaggatttttgctcagtcctggga

SEQ ID NO: 106635 - DNA, 201 bp, Bos taurus; identical to SEQ ID NO: 25617

SEQ ID NO: 106636 - DNA, 201 bp, Bos taurus; identical to SEQ ID NO: 25618

SEQ ID NO: 106637 - DNA, 201 bp, Bos taurus; identical to SEQ ID NO: 25619

SEQ ID NO: 106638 - DNA, 201 bp, Bos taurus; identical to SEQ ID NO: 25620

SEQ ID NO: 106639 - DNA, 201 bp, Bos taurus; identical to SEQ ID NO: 25622

SEQ ID NO: 106640 - DNA, 201 bp, Bos taurus; identical to SEQ ID NO: 25623

SEQ ID NO: 106641 - DNA, 201 bp, Bos taurus; identical to SEQ ID NO: 25624

SEQ ID NO: 106642 - DNA, 201 bp, Bos taurus; identical to SEQ ID NO: 25625

SEQ ID NO: 106643 - DNA, 201 bp, Bos taurus; identical to SEQ ID NO: 25626

SEQ ID NO: 106644 - DNA, 201 bp, Bos taurus; identical to SEQ ID NO: 25627

SEQ ID NO: 106645 - DNA, 201 bp, Bos taurus; identical to SEQ ID NO: 25628

SEQ ID NO: 106646 - DNA, 201 bp, Bos taurus; identical to SEQ ID NO: 25629

SEQ ID NO: 106647 - DNA, 201 bp, Bos taurus; identical to SEQ ID NO: 25630

SEQ ID NO: 106648 - DNA, 201 bp, Bos taurus; identical to SEQ ID NO: 25631

SEQ ID NO: 106649 - DNA, 201 bp, Bos taurus; identical to SEQ ID NO: 25632

SEQ ID NO: 106650 - DNA, 201 bp, Bos taurus; identical to SEQ ID NO: 25634

SEQ ID NO: 106651 - DNA, 201 bp, Bos taurus; identical to SEQ ID NO: 25635

SEQ ID NO: 106652 - DNA, 201 bp, Bos taurus; identical to SEQ ID NO: 25636

SEQ ID NO: 106653 - DNA, 201 bp, Bos taurus; identical to SEQ ID NO: 25637

SEQ ID NO: 106654 - DNA, 201 bp, Bos taurus; identical to SEQ ID NO: 25638

SEQ ID NO: 106655 - DNA, 201 bp, Bos taurus; identical to SEQ ID NO: 25639

SEQ ID NO: 106656 - DNA, 201 bp, Bos taurus; identical to SEQ ID NO: 25640

SEQ ID NO: 106657 - DNA, 201 bp, Bos taurus; identical to SEQ ID NO: 25641

SEQ ID NO: 106658 - DNA, 201 bp, Bos taurus; identical to SEQ ID NO: 25642

SEQ ID NO: 106659 - DNA, 201 bp, Bos taurus; identical to SEQ ID NO: 25643

SEQ ID NO: 106660 - DNA, 201 bp, Bos taurus; identical to SEQ ID NO: 25644

SEQ ID NO: 106661 - DNA, 201 bp, Bos taurus; identical to SEQ ID NO: 25645

SEQ ID NO: 106662 - DNA, 201 bp, Bos taurus; identical to SEQ ID NO: 25646

SEQ ID NO: 106663 - DNA, 201 bp, Bos taurus; identical to SEQ ID NO: 25648

SEQ ID NO: 106664 - DNA, 201 bp, Bos taurus; identical to SEQ ID NO: 25649

SEQ ID NO: 106665 - DNA, 201 bp, Bos taurus; identical to SEQ ID NO: 25650

SEQ ID NO: 106666 - DNA, 201 bp, Bos taurus; identical to SEQ ID NO: 25651

SEQ ID NO: 106667 - DNA, 201 bp, Bos taurus; identical to SEQ ID NO: 25652

SEQ ID NO: 106668 - DNA, 201 bp, Bos taurus; identical to SEQ ID NO: 25653

SEQ ID NO: 106669 - DNA, 201 bp, Bos taurus; identical to SEQ ID NO: 25654

SEQ ID NO: 106670 - DNA, 201 bp, Bos taurus; identical to SEQ ID NO: 25655

SEQ ID NO: 106671 - DNA, 201 bp, Bos taurus; identical to SEQ ID NO: 25656

SEQ ID NO: 106672 - DNA, 201 bp, Bos taurus; identical to SEQ ID NO: 25657

SEQ ID NO: 106673 - DNA, 201 bp, Bos taurus; identical to SEQ ID NO: 25658

SEQ ID NO: 106674 - DNA, 201 bp, Bos taurus; identical to SEQ ID NO: 25659

SEQ ID NO: 106675 - DNA, 201 bp, Bos taurus; identical to SEQ ID NO: 25660

SEQ ID NO: 106676 - DNA, 201 bp, Bos taurus; identical to SEQ ID NO: 25661

SEQ ID NO: 106677 - DNA, 201 bp, Bos taurus; identical to SEQ ID NO: 25662

SEQ ID NO: 106678 - DNA, 201 bp, Bos taurus; identical to SEQ ID NO: 25663

SEQ ID NO: 106679 - DNA, 201 bp, Bos taurus; identical to SEQ ID NO: 25664

SEQ ID NO: 106680 - DNA, 201 bp, Bos taurus; identical to SEQ ID NO: 25665

SEQ ID NO: 106681 - DNA, 201 bp, Bos taurus; identical to SEQ ID NO: 25666

SEQ ID NO: 106682 - DNA, 201 bp, Bos taurus; identical to SEQ ID NO: 25667

SEQ ID NO: 106683 - DNA, 201 bp, Bos taurus; identical to SEQ ID NO: 25668

SEQ ID NO: 106684 - DNA, 201 bp, Bos taurus; identical to SEQ ID NO: 25669

SEQ ID NO: 106685 - DNA, 201 bp, Bos taurus
gctctggggtctcttggttttcaggcgtcctaatagattccagctcccctctctccacctcccctccaccccccagctgttgcagaaaaccacagtcaacttcttcttgctctcagctgccaagttttctctaagtaaacacagaatgtagcagtagatcagctcagttgcattcccagcactgtaggttgggtcaaggct

SEQ ID NO: 106686 - DNA, 201 bp, Bos taurus; identical to SEQ ID NO: 25670

SEQ ID NO: 106687 - DNA, 201 bp, Bos taurus; identical to SEQ ID NO: 25671

SEQ ID NO: 106688 - DNA, 201 bp, Bos taurus
cagtcactgaagggttcttagcaggtgagggtcacactgggactcgtgtttgggagggaacactgccccttgctcaccttcgtagtgtcatctagcatcatgccttccggccttccctgggctctggtccctctgatcttctctcattttcagtgatgaaaatgcttccatccttccaggcttctacagaagccattcctt

SEQ ID NO: 106689 - DNA, 201 bp, Bos taurus
gtggtctgcatctagctctctgactgtctcccactttacctccttgggcttaccatgctgcagtcgtatctgctctcctcctttttcttaaagagctgtacctgttcctacctcagggcctttgcctctgcggttccctctgcctgggactccctttctcaagttcctttcatggctgattcctttcattgcttaaggctt

SEQ ID NO: 106690 - DNA, 201 bp, Bos taurus
cagcaatggtggggaaatcatctctggggctggaacaaggctgtatcctctttgtgctcatttctccccgccccatctcccctgtgcacgtggccttgccccccctttacaaagatggtgcagtggttaacagtgtgagcttgagtcagtacttgttgaaactgagttccaggcctgccagtaacttgctgggggatggtg

SEQ ID NO: 106691 - DNA, 201 bp, Bos taurus; identical to SEQ ID NO: 25672

SEQ ID NO: 106692 - DNA, 201 bp, Bos taurus
ttagatatttttctttaaatagatcattttgaaaagatttatttctagctgttttctttggctcattactaatatgtattgttagtgtcctgataacccatttcagccttctttctgaggtaaaggcattaaagtatttttttaaaatgaccttctggaagcttaatttgcctcattctcaatgtgtgctcagtcgctgag

SEQ ID NO: 106693 - DNA, 201 bp, Bos taurus; identical to SEQ ID NO: 25674

SEQ ID NO: 106694 - DNA, 201 bp, Bos taurus; identical to SEQ ID NO: 25675

SEQ ID NO: 106695 - DNA, 201 bp, Bos taurus
ttacactattatttaacctggattctgtccagactcagcccttccagacagcggcagcgtccagtgcagtgggcgatgggaggctggcctcagaatcaacgccctgtgatttctggaattcggaggcagtctccactgtccttgcactcccttggtcggcagatcttgggtgccaggcagccttattacaacctggcacag

SEQ ID NO: 106696 - DNA, 201 bp, Bos taurus; identical to SEQ ID NO: 25676

SEQ ID NO: 106697 - DNA, 201 bp, Bos taurus; identical to SEQ ID NO: 25677

SEQ ID NO: 106698 - DNA, 201 bp, Bos taurus; identical to SEQ ID NO: 25678

SEQ ID NO: 106699 - DNA, 201 bp, Bos taurus
ggatacactcatgaggactctgggtgtaagtgacagaaaatcaactccaattgacattcatcaaagtagggaagtagagagataataattctcctgttgagctacagaaaaaggcaggcaggaaataggctctagggatgcccagaatcaaggactcagaccctgcagtcctctgtctccactctttttcaaagccagctc

SEQ ID NO: 106700 - DNA, 201 bp, Bos taurus
tgtactagatttaattttatagagcacacaagaggagtccagcaagcttacctgtgactctcagaaaacgaactttttttttccaccaccatctttgattcaaaaaaaagagcaatgtctagaatcatgcccttgggttgagagaccatatgggtagagaaacaacaactggaacagaagttaggagccatgcattctagg

SEQ ID NO: 106701 - DNA, 201 bp, Bos taurus
ctgactctgtgactacaaagatggtgcccttattgcatcaagcaccgaggctccaaggccaaccgggcatgagggctgggccgctcccccctccccaaccgtgaccttacgggacgccctctgcagaggtaaacggcgggtgggagctggcaaagcaggcccagggcacagggttaggccctgataacccgagatcaaagc

SEQ ID NO: 106702 - DNA, 201 bp, Bos taurus; identical to SEQ ID NO: 25679

SEQ ID NO: 106703 - DNA, 201 bp, Bos taurus
tgccttccgagtgcctggcaccgtgccaacctcgctcctgtgctacctcacccatcctccccatcatgctctgaggccagtaattactatcacggcattaacctcagagcctctgtgctctcagattcccatgatgtcacatcacagagcaggtctcagctgtcacttccagtcccctagcagaggccacagatacacggg

SEQ ID NO: 106704 - DNA, 201 bp, Bos taurus
ttttgacaagagaccctgtgacttgtagagtcaaaaattttctttctgtggcctcttgcagaaaaagtttgctggcctcatgtctaaagaaaaggttggctactaccccctgatttttcaaaatggaaaacagcgctacaaatccggagaaagtctggaggcctttgaagtgaagtgaaatgaaagtcgctcagttgtgtc

SEQ ID NO: 106705 - DNA, 201 bp, Bos taurus; identical to SEQ ID NO: 25680

SEQ ID NO: 106706 - DNA, 201 bp, Bos taurus
atgggattttccaggcaagagtactggattggggtgccattgccttctccagtaatgtgctcagtcatgtctaatctttgctaccctatggacagtagcccaccagtctcctctgtccatttttcatacaagaatactggactagcttgccattttctcctccaggggatcttcctgatccaggggtcgaacctgtgtctc

SEQ ID NO: 106707 - DNA, 201 bp, Bos taurus; identical to SEQ ID NO: 25681

SEQ ID NO: 106708 - DNA, 201 bp, Bos taurus; identical to SEQ ID NO: 25683

SEQ ID NO: 106709 - DNA, 201 bp, Bos taurus; identical to SEQ ID NO: 25684

SEQ ID NO: 106710 - DNA, 201 bp, Bos taurus
tactcttcagagtcaggataaagaaaccagattgagtgctgtcatgccagatgacttgcctgagattttctcaggggcccagatcagagttgatggtagagtgtaagctattaactttcagtgttgtctgtaactttagaccatactgccactgcagggttttttggggactttttccatcagccatgttcagtctgcccc

SEQ ID NO: 106711 - DNA, 201 bp, Bos taurus; identical to SEQ ID NO: 25688

SEQ ID NO: 106712 - DNA, 201 bp, Bos taurus; identical to SEQ ID NO: 25689

SEQ ID NO: 106713 - DNA, 201 bp, Bos taurus; identical to SEQ ID NO: 25690

SEQ ID NO: 106714 - DNA, 201 bp, Bos taurus; identical to SEQ ID NO: 25691

SEQ ID NO: 106715 - DNA, 201 bp, Bos taurus; identical to SEQ ID NO: 25692

SEQ ID NO: 106716 - DNA, 201 bp, Bos taurus
cagatgaaaaaacgcctagagacaacaacatgttctacatcacatagtaggtagcagagccaggattcaaatccaggcccatcttcccctcaaacctggattgagtttttcaagtagcctggtgactctattgtctagagctaagaagctgtggacagagtgtggaccctctggccccgttccatctttggttaaccgtct

SEQ ID NO: 106717 - DNA, 201 bp, Bos taurus
acgtaaagtcgttgaacttgtgaaagtctatttttttcccctgtaagtctatttttcacagaatataagaaacgtcaatgaccaaatctgtccttcctccctttccccttccttcacctaagatcctcgttccagtttctattgtctttgtgtccaaagtaaactaggtgacttatttgtataaaatgttattttgccaca

SEQ ID NO: 106718 - DNA, 201 bp, Bos taurus; identical to SEQ ID NO: 25693

SEQ ID NO: 106719 - DNA, 201 bp, Bos taurus; identical to SEQ ID NO: 25694

SEQ ID NO: 106720 - DNA, 201 bp, Bos taurus
gggacagctgccttctgctgcacccgtgtgagatgcagtcccgcgcaggcgcagtccctcggcgggagcgcagacaggaggcgggaggcaggtgggcctacttctcggtaagtgacaactggaggacttgctgcagctccgcctcctcctcgcgcagccgcagctcgcgctcctccagctctttggcggagagctccatgg

SEQ ID NO: 106721 - DNA, 201 bp, Bos taurus; identical to SEQ ID NO: 25695

SEQ ID NO: 106722 - DNA, 201 bp, Bos taurus; identical to SEQ ID NO: 25698

SEQ ID NO: 106723 - DNA, 201 bp, Bos taurus
tgccgtctctcccctgcacaggtgcgctggccagggtccaggtgttcgggaagtggcacagtgtcccaaggaagcaggcgacctacggcgacactgggctaacctacacgttttcaggcctcactctgtctccgaagccctggatccccgttctggagcgtgtacgggatcgtgtttctctggtgactggacagaccttca

SEQ ID NO: 106724 - DNA, 201 bp, Bos taurus; identical to SEQ ID NO: 25700

SEQ ID NO: 106725 - DNA, 201 bp, Bos taurus
catgtgctctttttgcgccagtggccgcaggacggattcctctcctccgactgatcaagcctgggagggcagagtgtagagtcagccctgtgagagtaaaggagggggcccagaggagagtcgaggcgaaacgtccagacagggaggtggaactccggccaggaaaccacaggcgtccaccttgacagcctgagggcgctg

SEQ ID NO: 106726 - DNA, 201 bp, Bos taurus; identical to SEQ ID NO: 25703

SEQ ID NO: 106727 - DNA, 201 bp, Bos taurus
actgcgtgggccagcagctgccttcagaatcatcctgggtgtttgctaaaattcacattgctagaccccaccccatacctacagagtcagaggttggaacggaggtgggccgaacttggctttttttttttttttttttttttttgcgctaatgcatttgagaatgccctgctcctgagccctcaaaactgcaatacattg

SEQ ID NO: 106728 - DNA, 201 bp, Bos taurus; identical to SEQ ID NO: 25705

SEQ ID NO: 106729 - DNA, 201 bp, Bos taurus; identical to SEQ ID NO: 25706

SEQ ID NO: 106730 - DNA, 201 bp, Bos taurus; identical to SEQ ID NO: 25707

SEQ ID NO: 106731 - DNA, 201 bp, Bos taurus; identical to SEQ ID NO: 25708

SEQ ID NO: 106732 - DNA, 201 bp, Bos taurus; identical to SEQ ID NO: 25709

SEQ ID NO: 106733 - DNA, 201 bp, Bos taurus
ttctgccccctccatgctcgtgcctcctggcatcattgcttctgtaacgccatccgggaatgtgggctccagggcttccacccaacaaaacacactcctcaggccacagttctcagctctgatctgcatttgtttccagcctcctgggacacaccgcccttgaagacttcccgattccacgactgtccggagagagagaca

SEQ ID NO: 106734 - DNA, 201 bp, Bos taurus
tgtatcctttaccagtgtcaattatacttcatccaacccaacacacatgcatagttctgctaagtgcaagcaccaaatgcacgcactactaagctataacgctagtaagcactactagtagtactaagtgccagctcaagtaccaagtgctactacttgggagcactactgtgaatattaagtactgctacttagcagcac

SEQ ID NO: 106735 - DNA, 201 bp, Bos taurus
gtccccagggtcctgatatttgggcagaagaagaggcaggggccactaacacctccgaaagttgagatgcatcccagggaccctggcttcccagagaagcctcaaatcaacatggccctcaaccatagactagcaataacccagcaagttggctagacttgaggcagccactcagaactcccagggggtgcagtaaaatcc

SEQ ID NO: 106736 - DNA, 201 bp, Bos taurus
tttgaattcttacagcagggcaccatgcttcccacattggtgtgcgacttgcttttctacttcttgggtccctttgctgtaattggaacaaggcccagaattaatccgagatagactgtcttttgctggctgcctccccactctcgataccctgtacccacttctggggtcctttctctgatgcctcctctctgccacctc

SEQ ID NO: 106737 - DNA, 201 bp, Bos taurus; identical to SEQ ID NO: 25710

SEQ ID NO: 106738 - DNA, 201 bp, Bos taurus; identical to SEQ ID NO: 25711

SEQ ID NO: 106739 - DNA, 201 bp, Bos taurus; identical to SEQ ID NO: 25712

SEQ ID NO: 106740 - DNA, 201 bp, Bos taurus
cgtgtgggccgtggtgaaggctctggggaagagccagctgaagtcaggaaagacctcggtgctcaaaaggagatgctggggctgggctgtggctcaggcctaatggaggagtggtgtctgctgtggggcgggtggggtggtgggtggttagaagcatactcagccttccaagattttggccgctgctgctgctaagttgct

SEQ ID NO: 106741 - DNA, 201 bp, Bos taurus
aatacatgttagaatgctgtattaaaatatctttgggaaaattcacaaacatgctgatcttggttacttgggaggagggcccctgggtggctagtgcaaagggggggacttttcacagtttattgtttaataccttctggattttgaactatgcattgggttggccaaaaagttcattcggatgtttccagatgacgttac

SEQ ID NO: 106742 - DNA, 201 bp, Bos taurus; identical to SEQ ID NO: 25713

SEQ ID NO: 106743 - DNA, 201 bp, Bos taurus; identical to SEQ ID NO: 25714

SEQ ID NO: 106744 - DNA, 201 bp, Bos taurus
tctgagctcttaatctgagagaagggcaacggccacatcctgagccctcggtacctttatttcacttgataaggggcctgcttcacgctgtttgtgccccagctgactgtccctgaaggggtggacacagagtggtacccagacatcatgagagggcccagcacttgggagctcaggctctgaagtgcggcagcctgggtt

SEQ ID NO: 106745 - DNA, 201 bp, Bos taurus; identical to SEQ ID NO: 25715

SEQ ID NO: 106746 - DNA, 201 bp, Bos taurus; identical to SEQ ID NO: 25716

SEQ ID NO: 106747 - DNA, 201 bp, Bos taurus
tgtgaaatggggatggtggaccctagcacatagtagactcttcttaaatattagctcttgttgttacagcactgaggcctcagtcacctcttttcaatctattaatatgaaaataaaattttaaatgtgcaaaaagatagccaccggggtccccctgtccctgaggccttccagggtggagggtccccctccatgtactcc

SEQ ID NO: 106748 - DNA, 201 bp, Bos taurus
ccaggttccctcagagcagaaaacttcatcacattcaggtagaagcagagagagtccagactctgtgaagagaagcatctgctaggagaggattaaggcatggccaatggggcagtattcgaacccaggcagccagccgcagagcctgggtttttactccaccatccacagccggagaggggcagggggcttccctgatgg

SEQ ID NO: 106749 - DNA, 201 bp, Bos taurus
aattccagctgtgccattcacacgttgggtgaccttggccaagtcttcctccagcccctcatctggaaagcagagatgaagctagtgcccttttccctggctgctgctggatcgccaaggccagaacacaccagggaaggttgtcagcccctgcagggttaaggccgtgcctcgtcacgtggctggttgcccttcttactg

SEQ ID NO: 106750 - DNA, 201 bp, Bos taurus
aaataaaaagaatgctatggtttgaaactcctactattgtggcaaattaaatctttaaatcattggaaaagctgaagtattactatcacgtatgcagtatacccaagattacaagggcataaacttaaaagatattaataaaggagggctaattctctgagcacgtgctacttttgaaatcttgggaaattcacacaaagg

SEQ ID NO: 106751 - DNA, 201 bp, Bos taurus; identical to SEQ ID NO: 25717

SEQ ID NO: 106752 - DNA, 201 bp, Bos taurus
gggcctggactgtcctgaccatctgctccagggctccaaagccagatgctgagtggcattctgttgtctctagctatgcagcttatcagcctcctggcctccctttcctgggcaacatacctctgcatgggcggctatgataatgtgtaccgtctacaggcacagagataaaggcccagggctggctcaggagggggcagg

SEQ ID NO: 106753 - DNA, 201 bp, Bos taurus
actggctgggacatgggctctgtgctaatctatggcccctgtcatttgattctccagtaacccatttaaacatgaggatgagagatgctgacagaggagtaacacatccagggccaaaacaagtgcacgtgcttaggagcctcaaggcagggtcttggcgggaaaggagcaggtgagcctgggcgggaaaggatgagattc

SEQ ID NO: 106754 - DNA, 201 bp, Bos taurus
agggcccaatctttcccttcatccgtgggagctccccttcaccttcccgggacagcatcaggagtgactcagcagacggctgatcctgctgctctgagcccggcaggcctctgggaactcggccaggagcgtggcagtctgcggctctgcactgggcctctgggaactcggcccagaaagtggcagagtgcggctctgcac

SEQ ID NO: 106755 - DNA, 201 bp, Bos taurus
catcagccagaggaggtggccctgaccagaaggggaagagcccgctgccttcctccgagatccccaggaacagacaccaagcttgggccaggacacccccgtgccagcttgaggtcggaggagaaatggagtctgccatccactggctgtgtgacctttggcaaattatttaacacatctgggcctcagttccttcatcta

SEQ ID NO: 106756 - DNA, 201 bp, Bos taurus; identical to SEQ ID NO: 25718

SEQ ID NO: 106757 - DNA, 201 bp, Bos taurus
ccaaggcaagttgcttcgcatctctgggccgtggaggcccccaccacctataaaatgaggatttgaaaagtatctctcagctacctcactgggctgctgctatcatggacataaaaggcaaaggcccttggaaggaaaaaggagcgatgaagcagtctgcttccaagtattggctgtcggggaggcggggtaggggggcgg

SEQ ID NO: 106758 - DNA, 201 bp, Bos taurus
gggcctctgggcagaggaggacggtcaccaaacaagccggcacggctcacggagcctcgcctacgaagggacctttgttgcctgagctggaaaaagggacgccttactcaggacccaggcctcctctcaggcgtcaagagggggctggcacactcactcagaggagcgcacccccttgcccttggctccaggaaagagtca

SEQ ID NO: 106759 - DNA, 201 bp, Bos taurus; identical to SEQ ID NO: 25719

SEQ ID NO: 106760 - DNA, 201 bp, Bos taurus
tccgagggccaccttgcgtgttggctctgctcagtgcatgacccgctccctccacgtttgccctctgagcaagctgctacagaccaggagagtcactgtaagtggccgcctgggtttgagcgagccctgaggatgctgtccctcaggcacagcggtcctgaatgacagtgcaggcatagtggcctgagagccctttgtcag

SEQ ID NO: 106761 - DNA, 201 bp, Bos taurus; identical to SEQ ID NO: 25720

SEQ ID NO: 106762 - DNA, 201 bp, Bos taurus; identical to SEQ ID NO: 25721

SEQ ID NO: 106763 - DNA, 201 bp, Bos taurus
atcctgaaagccaattaaagaaagtgtttcagattggtagagtgatcggttttatcaaatgctccttctaagtcatataattgaggattgagaatttcctgtaacatctaatatgctagaggtccaaattatttgactggcatagacttaagctgtcctgccccaaagatctttcctattatcttctcataatgtttgagt

SEQ ID NO: 106764 - DNA, 201 bp, Bos taurus
tgctgggtgccagtgccattgtgaaggcagagtcaggtataaatgattcagtgcaggtcctgtggcaatgggtgggagttcagatgaggccaaggtgaacgactggagaacagtgatgaccatgatagaaatgaactgaacctggaccaacatccccagagctcccctggccgccactccatcaaacggtgcagactgccc

SEQ ID NO: 106765 - DNA, 201 bp, Bos taurus; identical to SEQ ID NO: 25723

SEQ ID NO: 106766 - DNA, 201 bp, Bos taurus; identical to SEQ ID NO: 25724

SEQ ID NO: 106767 - DNA, 201 bp, Bos taurus
atgattgtataatctttttctcccagacatgctataattccatctttgatttctccttgagccacaatctaggagagagagtttcagtcttccagtggccacattttcacattgctctgcgttgttgtggtttatactttgacgggtggttgctggttgtgtgtaatatcggcctgggatcggctggtgtgcaggatatga

SEQ ID NO: 106768 - DNA, 201 bp, Bos taurus
ccttgcagaaggtgactatctgtggaccggtccgctttcttggacgtctgatctgatgacaccaacacgaccctcaggccacgctgaccctgggcaacccaagctcccccaccatctgcaggaccaaccaaggtctccgcctgaccatgggccttaaagatcactgtgcgagggggcagtaaagaccctcccaattacctg

SEQ ID NO: 106769 - DNA, 201 bp, Bos taurus
agcccttcaatgggcttacctgatagttaatgaacgtatgtcattataatgacaagcacaacaggcttatgtgggttttgagggatgggcctgccctggatggaggacaggtgtgtgtccggcaggtggagagaggctcagttagcccagcccagtgctcagggaggttggcctctggcttctgtcgcccggagtcctcca

SEQ ID NO: 106770 - DNA, 201 bp, Bos taurus; identical to SEQ ID NO: 25726

SEQ ID NO: 106771 - DNA, 201 bp, Bos taurus
tatctgtggtctttaggacggcccttctgacgggtgtgaggagccaccactgcggctccgacgtgcttttctctgttgttccgtctttgtgggaaccgcgtgcgtcagcgagtaatcacggccacgggtcttgctgctgccgcccagcctcttgcttctcctttcgtcctctctgagccttaatttaaggtgtgtgtcttg

SEQ ID NO: 106772 - DNA, 201 bp, Bos taurus; identical to SEQ ID NO: 25727

SEQ ID NO: 106773 - DNA, 201 bp, Bos taurus
ccccgcagcctgcagtggggagtgggggcctgcgccatggacggcaccagatctgatcctgacaccggcacgcctgcagagacagggccgcccttcccggggtctctggaagttctccatcaaacaacagtaggtctgagccacctggcacagggctggggggcgtttgcagtggccccaacttggaagcctgatagctgg

SEQ ID NO: 106774 - DNA, 201 bp, Bos taurus
tcggtcagctccctggctgctgggagaggcctgttgagttgcctgtcctgcttagagtcttgggggtacagctggttgggtccctacctcactgtggcagaagggctggtgagggccctggctggggcaaggcagggcccctgacagctgtgcctccctcccccccagtggcccatcatgacctggacaacacactcaact

SEQ ID NO: 106775 - DNA, 201 bp, Bos taurus; identical to SEQ ID NO: 25729

SEQ ID NO: 106776 - DNA, 201 bp, Bos taurus; identical to SEQ ID NO: 25730

SEQ ID NO: 106777 - DNA, 201 bp, Bos taurus; identical to SEQ ID NO: 25732

SEQ ID NO: 106778 - DNA, 201 bp, Bos taurus; identical to SEQ ID NO: 25733

SEQ ID NO: 106779 - DNA, 201 bp, Bos taurus; identical to SEQ ID NO: 25734

SEQ ID NO: 106780 - DNA, 201 bp, Bos taurus; identical to SEQ ID NO: 25735

SEQ ID NO: 106781 - DNA, 201 bp, Bos taurus
gctgccaccatgttagaacagttggggcctgaagcaggccagggggctctccaaggaggaaatgttctatttactgggagtgaggattatgcctgggggcaggaaatggaggcctctccccagaggtgctgctgttgctttaatttgcatgatcaggcgcagctggggagaataatgtactgaccaacacaaacagaccat

SEQ ID NO: 106782 - DNA, 201 bp, Bos taurus; identical to SEQ ID NO: 25737

SEQ ID NO: 106783 - DNA, 201 bp, Bos taurus; identical to SEQ ID NO: 25738

SEQ ID NO: 106784 - DNA, 201 bp, Bos taurus; identical to SEQ ID NO: 25739

SEQ ID NO: 106785 - DNA, 201 bp, Bos taurus
cagaacagaacctagatcctctgagccttatgaatgcgggaaaatcacttccgtcactctgaagtgaagctaggaacttaccgccgtccctcagggacttcagtagcaccaaactctgttccttgtaatgggtttgaaagatttgaagaccttaagcagaaatattaacctgttggcagtagcttcctaaggagtcattca

SEQ ID NO: 106786 - DNA, 201 bp, Bos taurus
gtgtaggtggcctggttaccacttctggagacacatctgcctgagtcacttctcctactttcctatccctggtcatacaccagacttttccccaaggcacacccatgggcctggaagtatgaaaaaacagaatattctgtaacaggggtcagcaaacattttctgatgcaactactcaactattcaaggttgtagtgtgaa

SEQ ID NO: 106787 - DNA, 201 bp, Bos taurus; identical to SEQ ID NO: 25740

SEQ ID NO: 106788 - DNA, 201 bp, Bos taurus; identical to SEQ ID NO: 25742

SEQ ID NO: 106789 - DNA, 201 bp, Bos taurus; identical to SEQ ID NO: 25743

SEQ ID NO: 106790 - DNA, 201 bp, Bos taurus; identical to SEQ ID NO: 25744

SEQ ID NO: 106791 - DNA, 201 bp, Bos taurus; identical to SEQ ID NO: 25746

SEQ ID NO: 106792 - DNA, 201 bp, Bos taurus
taaatgggggtcgtcactagacacgcagcaagaggcagtgagagctgaataaagagaaggggcttacttcaaagaccagcgtctcattgatggggcccggggcagacaggcattcggggcggttgaaggcacgctggtactcaaacacggtccccgcaaaggcaaactcccctggccagtcgacgctccagccccctgtga

SEQ ID NO: 106793 - DNA, 201 bp, Bos taurus; identical to SEQ ID NO: 25747

SEQ ID NO: 106794 - DNA, 201 bp, Bos taurus; identical to SEQ ID NO: 25751

SEQ ID NO: 106795 - DNA, 201 bp, Bos taurus; identical to SEQ ID NO: 25753

SEQ ID NO: 106796 - DNA, 201 bp, Bos taurus; identical to SEQ ID NO: 25754

SEQ ID NO: 106797 - DNA, 201 bp, Bos taurus; identical to SEQ ID NO: 25755

SEQ ID NO: 106798 - DNA, 201 bp, Bos taurus; identical to SEQ ID NO: 25756

SEQ ID NO: 106799 - DNA, 201 bp, Bos taurus; identical to SEQ ID NO: 25757

SEQ ID NO: 106800 - DNA, 201 bp, Bos taurus
aacaatttgcccaaagtcatcaggacacaaaccctgctggtctgattctagagtctggtcttgactactgtgtaccatcccagggtatccactgttaatattgctggcctgtctcagcacgtcccctgggcctgtttacctctcccggcccctaacaatctcattcattcattcacctgtcagtctatccaatcatccata

SEQ ID NO: 106801 - DNA, 201 bp, Bos taurus; identical to SEQ ID NO: 25758

SEQ ID NO: 106802 - DNA, 201 bp, Bos taurus; identical to SEQ ID NO: 25759

SEQ ID NO: 106803 - DNA, 201 bp, Bos taurus
ctgcttgagaaactaccctgaaatgagaactctctggcttcacccaagacctcctgagtcacagactctggggctgggacccaacaagtggtgctttaggaggccttaccgagattctcaggtgcaaatgagtgtgagaagggctcctccccaaggccttctcacgcccctgtctttcagccaggtttccccgaatggtcg

SEQ ID NO: 106804 - DNA, 201 bp, Bos taurus
tggcagctctagaagtggaggagggccgtggacgagctcgcctaacactcttgttctggggagcctgggaggatagattccattctgcaagcaggaggccagggagttcgctcatggtgcaggagacagcaggtcatttacactgtgtttgcgatcaggggtcacagagaggggccaggagttgaattccaagaatggcac

SEQ ID NO: 106805 - DNA, 201 bp, Bos taurus; identical to SEQ ID NO: 25760

SEQ ID NO: 106806 - DNA, 201 bp, Bos taurus; identical to SEQ ID NO: 25761

SEQ ID NO: 106807 - DNA, 201 bp, Bos taurus; identical to SEQ ID NO: 25762

SEQ ID NO: 106808 - DNA, 201 bp, Bos taurus; identical to SEQ ID NO: 25764

SEQ ID NO: 106809 - DNA, 201 bp, Bos taurus
gccacccacctaaaggaagggtctctcccgatgtagctgcaggctttgggtgcagaagcatcctgccctcggcgccagtggctgtagctcacacatgaggcgtccatccagatcctgggccctgggatgggaacacgaccaccaggccttgccccagcgccactccttgtgtgcagtgggtgcttaatcagtgctgacgga

SEQ ID NO: 106810 - DNA, 201 bp, Bos taurus
caggccagctgctccaccatcgccctgcagtctagaaagttcttggaactcattacacgcagtcagaactttttaggacttgaagtgaagctcacataacatgcaattagccatttggtggccttttgtaccgtcacggtgtcttagacaccccgtttatctggctccacagcagtctcgtcacctccaaaggcaccctgc

SEQ ID NO: 106811 - DNA, 201 bp, Bos taurus; identical to SEQ ID NO: 25766

SEQ ID NO: 106812 - DNA, 201 bp, Bos taurus
ttccttctctccagccctgctgaagatggccaagctgtctgctccaggtctcagatttgacagcagagggtcacaggcgtgtgtagcttggcccacatgtgttttgattttggaggtgggggaagagttgtcaccagttaaatctgagaaaatcacatacagttttggaatcctaacttctcctgcaaaatcaggaactat

SEQ ID NO: 106813 - DNA, 201 bp, Bos taurus
tggagttgtttagactggggaatgcaatgacccagggtgtctgtgtgaatgtgtgcttactctcacatttttgtgtagttgatggtggcaggaggatactagggggaggttaagtgcagacaagggaaaggaggagggtcatgtcttgtcgcacacacatatctttgacagcaaatcaatctgtcccccaaagagccaggc

SEQ ID NO: 106814 - DNA, 201 bp, Bos taurus
aggctggggtaactgaggcacaaagagatgagtgagaacttgtactgcttagcgggactctcatgagtatgtgcgtctcaggatctgctttaatgtgctacttctaaccctcccaacagccctgtgaggctgctaatggtacccccttcccacagacgtgagaacttggccaatatccccttgcttgcagttggcagaaac

SEQ ID NO: 106815 - DNA, 201 bp, Bos taurus
gagcaggcccagggcaccatggggaacggattggcgctttcatgatcagccctccagtcccagctgggacgaagatagaggcagaaatgtatggagacaggaagaggccaacagatagatttctgaacatggtgggggatgaatgtaaaacccacatctatttccttttctatcttgaaactaacactcattccaaattga

SEQ ID NO: 106816 - DNA, 201 bp, Bos taurus; identical to SEQ ID NO: 25769

SEQ ID NO: 106817 - DNA, 201 bp, Bos taurus
caatgatccccacctcctggtatccatgctcttatgtagcctcctcccaagttgaagagggatgacctgtgtagccaacagatctagcagaaatggcactgtatgtcctcaaggccttggtttttcgtattacttattgctgtgaggagagccaactaccatgttgcgagcaagtagccctatagagagagccacatgacg

SEQ ID NO: 106818 - DNA, 201 bp, Bos taurus; identical to SEQ ID NO: 25776

SEQ ID NO: 106819 - DNA, 201 bp, Bos taurus; identical to SEQ ID NO: 25777

SEQ ID NO: 106820 - DNA, 201 bp, Bos taurus
caaccactctatttccctttacctcattggtcagtctggatgtttgggatcccgtgaccacacttggatcccaactgctccgtcactggccaaagccactgagaaagttacaaaccgtgtgtcccaagtaccagcctaagacctgtcacaggacagacgccttacccccagccccaaggacatggccgtaagatcttccag

SEQ ID NO: 106821 - DNA, 201 bp, Bos taurus; identical to SEQ ID NO: 25779

SEQ ID NO: 106822 - DNA, 201 bp, Bos taurus; identical to SEQ ID NO: 25780

SEQ ID NO: 106823 - DNA, 201 bp, Bos taurus; identical to SEQ ID NO: 25781

SEQ ID NO: 106824 - DNA, 201 bp, Bos taurus; identical to SEQ ID NO: 25782

SEQ ID NO: 106825 - DNA, 201 bp, Bos taurus; identical to SEQ ID NO: 25785

SEQ ID NO: 106826 - DNA, 201 bp, Bos taurus; identical to SEQ ID NO: 25786

SEQ ID NO: 106827 - DNA, 201 bp, Bos taurus
tggatttccaaaggggccaaacatttacagaaatgacccaaactgtacaaataaaccataggtctggtggaggaggcagtttacattcctcggggtcagatgaagatgggagccggccctttgaaaaccactttgcatcaggttcgtgagctctgtgccccgtctgggatccctcaatcccatccaaatgcttcgggaaag

SEQ ID NO: 106828 - DNA, 201 bp, Bos taurus
cgcgcgcgagtggagctgctgtgcttgtgcggccggctgtgcatgggcgaacgtgcagggcaggagtgtttgcgcgtaaccgaaagtgtgtcctccgtgggcaggcagggcctgagcgctcgtgcgagggctggggcgcctgagccgtgtgaggggtgttctttggaaagacggatggaggccgtgcgccttgctcaggat

SEQ ID NO: 106829 - DNA, 201 bp, Bos taurus
tggagagaagctaaggttccctcccacaaaggaattccctaaaactgtgtacaatatcccaacacctgtgaatgaacctccaaactgcaagagacacacacgtcccaggttgagaatcaatggattaggataagattgagaagaaacaagaacacccaagcatgtcaaataccctctcagagacctagaggcttctagccc

SEQ ID NO: 106830 - DNA, 201 bp, Bos taurus; identical to SEQ ID NO: 25787

SEQ ID NO: 106831 - DNA, 201 bp, Bos taurus; identical to SEQ ID NO: 25788

SEQ ID NO: 106832 - DNA, 201 bp, Bos taurus
ctcccagggcccggctctgagctcaggggcccgactcacagacaatcccagattgaccgggagcccaagagaggtgtggaacagagaaaggaagcagtggtcagcccaagacccaccccaagggcctcccaggctgtgaccacagcggccaggctgccctccccccaggctggcccacacaccacctctgcccaccctggg

SEQ ID NO: 106833 - DNA, 201 bp, Bos taurus
gccagcacatacaagcctctgaaagaacatgtgtttgctcccgtgggcatgacctgcatttgacttcagagctcctgattcagctcagctctaatgaaggctcccggggccaacacagaccaaaacacaagggactgcagccaacatggagcagtcaaactcccccgactcctctcgaatagtcagacttcctccccttcc

SEQ ID NO: 106834 - DNA, 201 bp, Bos taurus
catcaggaagcatacacagattaaaaccaagagacttctctcctggctaccaccaaggagcttatatcaaacagccgctcctgctgggaccagccataaaggctgaaaaagggaagttaaaatgctgcttgaggaggcagagggcaggcttgcagaggagggacaggtgcctgccacgaccccacgcacgtgccacacata

SEQ ID NO: 106835 - DNA, 201 bp, Bos taurus
acagcacgtgcaaaggccggaggcagggcttggtctgcagcagagggggcagaggggaacagtgtcggggctcagcttccgggctgtgggaaggatgctgtattttgtccagaggccagggaagggctctgaacgatttaagcagggcagcgtgcgatctggtgtttgtgctttcgtaattaaatgtttgtttccagataa

SEQ ID NO: 106836 - DNA, 201 bp, Bos taurus; identical to SEQ ID NO: 25791

SEQ ID NO: 106837 - DNA, 201 bp, Bos taurus
ggggaatggtgccctgaaggcaggtcacaggcagccgtgggcaaggggctcgggtcagagtcacatgatgagaggtgggcctgcttccgcaggaaggacacacggacatgcggaaggagcaagcggctccaccgtcggacacgattcctgccactcctcctgcactcaggcaccctgtctggggccctgcgcccacaggca

SEQ ID NO: 106838 - DNA, 201 bp, Bos taurus; identical to SEQ ID NO: 25792

SEQ ID NO: 106839 - DNA, 201 bp, Bos taurus; identical to SEQ ID NO: 25793

SEQ ID NO: 106840 - DNA, 201 bp, Bos taurus
cttggcggcctgcacaaaccctgctgggcactggggtttgtactgttccccacgggtcaggcaggtggggctgcgggcatttctaggggcccagctgagcacagggtccccatccttctgcctcagactttcacctcttctcaggaagaggcacctcaggcgatccagaggcccttctcctgcatgctggcttccgtgcag

SEQ ID NO: 106841 - DNA, 201 bp, Bos taurus; identical to SEQ ID NO: 25794

SEQ ID NO: 106842 - DNA, 201 bp, Bos taurus; identical to SEQ ID NO: 25795

SEQ ID NO: 106843 - DNA, 201 bp, Bos taurus; identical to SEQ ID NO: 25796

SEQ ID NO: 106844 - DNA, 201 bp, Bos taurus
ttggataagctgattcaaaacctgaatagtgacctataaaagaatacatacaatttcacaatcaagtagtaccataaaagataatgtcatttaatacgaatatcttgaagagcttttgttactcttagaagttaccagaataattatgaaaaaaaaaaaaaaaaagagatgtgagaacatgatccctggcttcaggaaaaa

SEQ ID NO: 106845 - DNA, 201 bp, Bos taurus; identical to SEQ ID NO: 25797

SEQ ID NO: 106846 - DNA, 201 bp, Bos taurus
tcagctcttcgcatcagatcagcttatttaataactgaagaccagcttatttaatcagaacatgtataaatccctagttaacctgctgtttttctaataaggtctaatttgttcttcgtggaaaatgtcagggatcttatgtataggtatgtttagccatttaaagtttgctgtaagcaaacttaagtgatgacactcata

SEQ ID NO: 106847 - DNA, 201 bp, Bos taurus
acagcaacaaggcaaaagcaacagataacttacaggcaaactcccgtaaggatcagttgacttctcagcagaaactctgctggccagaaggcaactgcacaaaatatttaaagtaatgaaagggaaaaacctacaagcaagaatattctacactgaaaggccttcattcagactcgatggagaaatcaaaagctttacaga

SEQ ID NO: 106848 - DNA, 201 bp, Bos taurus
atttctgggaaagtatttctttgtcttacaaaagggaaaagataatgttatcataagtatgagtacctatttccttgttttatttgaaaaaattcctgatctgtttgatttcaaaccgccctctctccctctcttttactgtaccagtacagcctaagtttagagtaggttttttgatatctattaaaaagtattttatat

SEQ ID NO: 106849 - DNA, 201 bp, Bos taurus
taaaactggcaatttttgagtcattagctagaaagaatttaaagtccctgcttcctattggaattcagggaggagcctgtctttttgagatgacaggggtgtgtataatggttattctcacagaacagaaacaaatatagagggtctaacctagtactctcaaacttcccttgattttcacacgtagcaaagggacttaag

SEQ ID NO: 106850 - DNA, 201 bp, Bos taurus
tgtcagacactgaaaactagcttcaaattaagaaagcgtctaaggaaaataaaaagcacattcttaattaaaatcacacacttgtaattcttcaggtccatgactatcacaatgtttttcacaatggagaaaaagtgaatctctaactcaaaaataaactccacatctcttgctttacacaaaaatttaaaaaagagcatg

SEQ ID NO: 106851 - DNA, 201 bp, Bos taurus
aatcagtcctaacagtaaggcttggctaggagtccagagcagaactccagctcagggcccgccatgctgaagacagacccggccctgggagggtagcccccggctcctggctctgaactaagctgcccttcgtcttagggaaatattcaagtgacctctgctgccaggcttcacccagcttcagggatgctgttgccggcc

SEQ ID NO: 106852 - DNA, 201 bp, Bos taurus
gagtatctcgaaatctttgaacccccgtaactgagcaatcaatatgctcagaaggtcccgccaacctagcatcagtaactgaaggtaacagctgggagagcggcatcggtggagaaaggggtggacagccgggcttagactgaggtgagctacaacacctcgagcggttttcacaggcagacttcatactatttggaagca

SEQ ID NO: 106853 - DNA, 201 bp, Bos taurus; identical to SEQ ID NO: 25802

SEQ ID NO: 106854 - DNA, 201 bp, Bos taurus; identical to SEQ ID NO: 25804

SEQ ID NO: 106855 - DNA, 201 bp, Bos taurus; identical to SEQ ID NO: 25805

SEQ ID NO: 106856 - DNA, 201 bp, Bos taurus; identical to SEQ ID NO: 25806

SEQ ID NO: 106857 - DNA, 201 bp, Bos taurus; identical to SEQ ID NO: 25807

SEQ ID NO: 106858 - DNA, 201 bp, Bos taurus; identical to SEQ ID NO: 25808

SEQ ID NO: 106859 - DNA, 201 bp, Bos taurus; identical to SEQ ID NO: 25809

SEQ ID NO: 106860 - DNA, 201 bp, Bos taurus; identical to SEQ ID NO: 25810

SEQ ID NO: 106861 - DNA, 201 bp, Bos taurus
atgaaactgctgagctttgaagtcatgcattagcaaacttttcaaaagcctatttggaagaggtgctaatggcaggcatttggcagggccccaggaggccgagaaggtccttccttcagttagactggatctttgtttctctgagtcccgacaggtggtgctccctcagggccgagggactgatatcttcatcctttccat

SEQ ID NO: 106862 - DNA, 201 bp, Bos taurus
tgggcaggggcagagcaccatcacacccataactctgggagtcacctctaattcaagccagaagaatgaggctctagaaacccactaaccctctctcacttatcagtttagacaagcaaactcttctgatgcgtgcatgcgtgctcagtctctttcgtcatgtccaacactatgcgaccccgtggactgtagcccactagg

SEQ ID NO: 106863 - DNA, 201 bp, Bos taurus
tggccaaagtactggagtttcagctttagcatcattccttccaaaatgacttataatatttaatacatagcaaccattatgtaaataattgcaagtacaatgtaaatgctacataaatagttaccacaagaatggcaaattcaagttttgttttgaagaaatttctggaattttttcctattattttccatctgagggttg

SEQ ID NO: 106864 - DNA, 201 bp, Bos taurus; identical to SEQ ID NO: 25813

SEQ ID NO: 106865 - DNA, 201 bp, Bos taurus; identical to SEQ ID NO: 25814

SEQ ID NO: 106866 - DNA, 201 bp, Bos taurus; identical to SEQ ID NO: 25815

SEQ ID NO: 106867 - DNA, 201 bp, Bos taurus; identical to SEQ ID NO: 25816

SEQ ID NO: 106868 - DNA, 201 bp, Bos taurus
ttcttggcgctaccacttataaactccgtgattgagtgtgggtaggtaacaacctctggctcagtatccttgtctatgtatgcagagcccttgagatggtaacaggcatatagtacatgtttaataagggctaacagttcttatgggaacagtctcaacaggcttggactaaggtaatgagagtcttcctgggtacagtgt

SEQ ID NO: 106869 - DNA, 201 bp, Bos taurus; identical to SEQ ID NO: 25817

SEQ ID NO: 106870 - DNA, 201 bp, Bos taurus; identical to SEQ ID NO: 25819

SEQ ID NO: 106871 - DNA, 201 bp, Bos taurus; identical to SEQ ID NO: 25820

SEQ ID NO: 106872 - DNA, 201 bp, Bos taurus; identical to SEQ ID NO: 25821

SEQ ID NO: 106873 - DNA, 201 bp, Bos taurus; identical to SEQ ID NO: 25824

SEQ ID NO: 106874 - DNA, 201 bp, Bos taurus; identical to SEQ ID NO: 25825

SEQ ID NO: 106875 - DNA, 201 bp, Bos taurus; identical to SEQ ID NO: 25827

SEQ ID NO: 106876 - DNA, 201 bp, Bos taurus; identical to SEQ ID NO: 25828

SEQ ID NO: 106877 - DNA, 201 bp, Bos taurus
gcactggcaggaggattctttaccactgagtcaccaaggaagcccaattagaggtttaattcagttcaaatcaagttaattattcatttgcaaaataaaaaatgttttattggtgaagtactattgattggtaagcaccaaatgacaggaaaattttaaaattgatctgcaaattaaataggcaagactatggaagaagct

SEQ ID NO: 106878 - DNA, 201 bp, Bos taurus; identical to SEQ ID NO: 25829

SEQ ID NO: 106879 - DNA, 201 bp, Bos taurus; identical to SEQ ID NO: 25830

SEQ ID NO: 106880 - DNA, 201 bp, Bos taurus; identical to SEQ ID NO: 25832

SEQ ID NO: 106881 - DNA, 201 bp, Bos taurus
actgcacgtgtgagtagaatgagtcgaaaatgtgaatcaactgctaaaggccgatggtgggcaagtatgggagtatacagtccttaggagcatggacccagaggggagtttacactcactgcaggcccttctccctggaccccaaaaagggacccatgagaaatgctggtaacaggtagtacttgttattcttatgtgact

SEQ ID NO: 106882 - DNA, 201 bp, Bos taurus; identical to SEQ ID NO: 25833

SEQ ID NO: 106883 - DNA, 201 bp, Bos taurus
atgtgctgatggtggattctcaggccaccagccaggctgagggtagggggcacttgggaaggtagctctcccagagtccttcagtgataaccttatcagctggccaggtacctcgagggtagaaaggatatcaggcccaagacccagctctgcttctaagtgctgtgtgactttcagcaactcactgacctctctgaattt

SEQ ID NO: 106884 - DNA, 201 bp, Bos taurus; identical to SEQ ID NO: 25834

SEQ ID NO: 106885 - DNA, 201 bp, Bos taurus; identical to SEQ ID NO: 25838

SEQ ID NO: 106886 - DNA, 201 bp, Bos taurus; identical to SEQ ID NO: 25839

SEQ ID NO: 106887 - DNA, 201 bp, Bos taurus; identical to SEQ ID NO: 25840

SEQ ID NO: 106888 - DNA, 201 bp, Bos taurus; identical to SEQ ID NO: 25841

SEQ ID NO: 106889 - DNA, 201 bp, Bos taurus
ggagcatccttgcctgacaatgtagattggcagtgtgatatgactttcagcgacctaggataatgtgttccctccatgccaggctcagagctgagggcccgtgtgcgtcatctcacagcagtttcataacgagtccatcattatctgaagtgggcactggtcactcttggccaacagcatcagacatgcccttcctatgag

SEQ ID NO: 106890 - DNA, 201 bp, Bos taurus; identical to SEQ ID NO: 25843

SEQ ID NO: 106891 - DNA, 201 bp, Bos taurus; identical to SEQ ID NO: 25844

SEQ ID NO: 106892 - DNA, 201 bp, Bos taurus
aaacaaattttattacaatatgttatacaacttaattttcttcccctaccagcccacacctatatactttcccttacatcatcctctccatatttattgcgtatttatcactccaccatttttaatgttgtactcaagccctgcttagtcacaaaaaatatccctgacaagttcaggttcaggcagttttctctttaaact

SEQ ID NO: 106893 - DNA, 201 bp, Bos taurus; identical to SEQ ID NO: 25846

SEQ ID NO: 106894 - DNA, 201 bp, Bos taurus; identical to SEQ ID NO: 25847

SEQ ID NO: 106895 - DNA, 201 bp, Bos taurus; identical to SEQ ID NO: 25851

SEQ ID NO: 106896 - DNA, 201 bp, Bos taurus; identical to SEQ ID NO: 25853

SEQ ID NO: 106897 - DNA, 201 bp, Bos taurus; identical to SEQ ID NO: 25854

SEQ ID NO: 106898 - DNA, 201 bp, Bos taurus
agtgatttctcattgtatgcctaaattggtgacttaacttttcagttttacaaggtaaaattagaggaaaataagtggttactctgatgttcacacctgtgtatacatagctgcaggaagaattgagaaaagagagtgatgtgggtgacatgtacaatgcagagatatagaacaaaggccggcatctcgtggcctgaaact

SEQ ID NO: 106899 - DNA, 201 bp, Bos taurus
atacagaatatttgtaaatctgcctaacctcttatttttatttatttaaattaacagcagcagcattcattgccttttggcccccaggtacagtgaactattttttaaggaacttcaaaatatcatttaaaccttttaaaataattcagccaatacaagtgttgagaaagcatcatttgaattggcaaaccaaagaactgg

SEQ ID NO: 106900 - DNA, 201 bp, Bos taurus; identical to SEQ ID NO: 25856

SEQ ID NO: 106901 - DNA, 201 bp, Bos taurus
gtttggcctaggggtcggccacatactatcttcagcagcctcttggcataagccccagccttcccaaagcagcaggcatccccaagcaggggcccaacctcgaaagcagagataggtttaacaaaaacataatgttgactttccccctccagtggggctattctgtaatgtgacttccatatgtttatataaaatgagtgt

SEQ ID NO: 106902 - DNA, 201 bp, Bos taurus; identical to SEQ ID NO: 25857

SEQ ID NO: 106903 - DNA, 201 bp, Bos taurus; identical to SEQ ID NO: 25858

SEQ ID NO: 106904 - DNA, 201 bp, Bos taurus
tctcttcaaaatgttcagcagttagatagacagggcttgctttctgagccccctgatcactgtctgggttctttggttaagtcactttgtcctgcagaaccctgtttttgtctcagcttaaggaataataattcctataaaataatgttgacaggataaattaatttatgtatctgattccccttagtgaagtaacgggaa

SEQ ID NO: 106905 - DNA, 201 bp, Bos taurus; identical to SEQ ID NO: 25860

SEQ ID NO: 106906 - DNA, 201 bp, Bos taurus
cggcctgtcagttgtcttgacctcggggatcctggagccccagtgatttaggaatcactgaaaaagcatcactaggcaaagctattttaatgttaaataaataaaatttgcaggccaaattctcacctgtgacttctctcattctggctctgtgtttttaaaccagtctcaactgtatctaggcaaatgaaggatgcatag

SEQ ID NO: 106907 - DNA, 201 bp, Bos taurus
ttgctcacctcttctcaactctgtggtcagtgatgtctccttggcagcttgaaattggccacagtgggaatatttacactatggaattcagcaaaggtggcaaatcaccccatctgcaaggagtcagttgttgaataattccagcacaccactgctgtgaccactttctgaacagagccttggaataaataaccttctctt

SEQ ID NO: 106908 - DNA, 201 bp, Bos taurus; identical to SEQ ID NO: 25866

SEQ ID NO: 106909 - DNA, 201 bp, Bos taurus; identical to SEQ ID NO: 25867

SEQ ID NO: 106910 - DNA, 201 bp, Bos taurus; identical to SEQ ID NO: 25868

SEQ ID NO: 106911 - DNA, 201 bp, Bos taurus; identical to SEQ ID NO: 25870

SEQ ID NO: 106912 - DNA, 201 bp, Bos taurus; identical to SEQ ID NO: 25871

SEQ ID NO: 106913 - DNA, 201 bp, Bos taurus; identical to SEQ ID NO: 25872

SEQ ID NO: 106914 - DNA, 201 bp, Bos taurus; identical to SEQ ID NO: 25873

SEQ ID NO: 106915 - DNA, 201 bp, Bos taurus; identical to SEQ ID NO: 25874

SEQ ID NO: 106916 - DNA, 201 bp, Bos taurus; identical to SEQ ID NO: 25875

SEQ ID NO: 106917 - DNA, 201 bp, Bos taurus; identical to SEQ ID NO: 25876

SEQ ID NO: 106918 - DNA, 201 bp, Bos taurus; identical to SEQ ID NO: 25877

SEQ ID NO: 106919 - DNA, 201 bp, Bos taurus; identical to SEQ ID NO: 25878

SEQ ID NO: 106920 - DNA, 201 bp, Bos taurus; identical to SEQ ID NO: 25879

SEQ ID NO: 106921 - DNA, 201 bp, Bos taurus
ccaagatttcttgtttctccttcttgctacacagaattttttaatccagtgtgcacactgccatttcacagttgagtatatggcatcaagggtgacaaattaggcagccgcaatcagaattacaggtatcgtgggactaattccattccttgccctgatttcaatgtgtttcccatatgatatgacggaagaggactgcgt

SEQ ID NO: 106922 - DNA, 201 bp, Bos taurus; identical to SEQ ID NO: 25880

SEQ ID NO: 106923 - DNA, 201 bp, Bos taurus; identical to SEQ ID NO: 25881

SEQ ID NO: 106924 - DNA, 201 bp, Bos taurus
cctcatctagctttttgtttattggggggatttttaatgaggggggtgtggttaggggctcatgatcctccattactttcttttgcattattacatgaactgtttcatcagggaaatagagaaactaattccagcagcttacaaagattgagtacaaaggggatagcttgggatccttagtccaccaccaacatacatagc

SEQ ID NO: 106925 - DNA, 201 bp, Bos taurus; identical to SEQ ID NO: 25882

SEQ ID NO: 106926 - DNA, 201 bp, Bos taurus
cagtagatccagttaagaggaatggtagtaattaaacagtctaaaaaattccattgttgcaaacaaatactgaatttgttgaaaggccttaactatttccgggcataactaatttaaaaagatacacaccaaaatggaggacaggagttctggagtggggcccaaggttctgaaatcagctagttgccaggtgatggctgc

SEQ ID NO: 106927 - DNA, 201 bp, Bos taurus; identical to SEQ ID NO: 25883

SEQ ID NO: 106928 - DNA, 201 bp, Bos taurus; identical to SEQ ID NO: 25884

SEQ ID NO: 106929 - DNA, 201 bp, Bos taurus
tttgtaagaaaaatcactacccatataatttgaaggaacatgaaacttagttatgaaaattctttggcttttgtggtaagtttctaaccaactcaagcaacgtcagatgtattatcatttgggtccagtatacaatgccccttgtttcatttaaagaacccagactgaactatgtgaaacacatcgtctgtcctcagttaa

SEQ ID NO: 106930 - DNA, 201 bp, Bos taurus
gaggtgtgaaattagaagggagacgtggttgtgtttcctccaacagtcctaatgtgtagacaaaggctcagagagggagaagtagatcagttcaaaatatccccagcagtactgcagcagttactccaggagaccagttgtacttcatcacagtaggtttcaacatagagagagaagtgtttacatccaatagaaatatgc

SEQ ID NO: 106931 - DNA, 201 bp, Bos taurus
aaagagcttggtcaacataaaaaagctggaagtccaccttagacagagattatgccaagaatgacaatgaagtccatctggagaagtgggcaggggccaggtgtgtgtggcatgactgggacgtgtgttgtgaactttgggatttgctccgggtgaccattggagggctttggggaagggagcgacatggtcagatgtatt

SEQ ID NO: 106932 - DNA, 201 bp, Bos taurus; identical to SEQ ID NO: 25885

SEQ ID NO: 106933 - DNA, 201 bp, Bos taurus
gaaggttaaatattgcagcagtactgcttgactgagaggtggctcactcatgagttcacgctctgtcttgagatatgtgtacttggttagtcgctcagtcatatccgactgtctgcagccccatggactgtggcccactaggctcctctgcccatgggattttccaggcaaggatactggagtgggtttccatttcctact

SEQ ID NO: 106934 - DNA, 201 bp, Bos taurus; identical to SEQ ID NO: 25886

SEQ ID NO: 106935 - DNA, 201 bp, Bos taurus
tgaggctccttgcagcagacaagatagatctttaagagtttaagaaggagaagtcttaaaggtatttcactcagattaggccctgtttgatgatttcacattcaaaatgaagctacccacaaaaaaaactttgtgttgacaccggagggatggtgaacaccctaccccaacagcatctaccgccttgccggcccaccggtg

SEQ ID NO: 106936 - DNA, 201 bp, Bos taurus
agctgactaagaaggtggctaatgtccgtgtgtgcatgtgtgtgtgcagctgcgtgagtgccatgtatgagtgggcatgctgagaatgttcccagggcctagggggtgttccctcagtgtgctgaatacaggtccctcctctgaggagcttacaggggtctctgatcatgaccctgagcacattcccagggtgtggccaat

SEQ ID NO: 106937 - DNA, 201 bp, Bos taurus
caggaacagggagctttgaggggcccttaagtgccagagcattggtcccagggcagtccatggagttatcaatggggcaggccagaggcttctcagagtccggctagatcattcctggatgcagcaggagcagagctcagactgtctcttggaggtgatgtcctggccagcaggagcgagcgtgtagtttcagagaggagc

SEQ ID NO: 106938 - DNA, 201 bp, Bos taurus
gtcatcccacccctgtatatggttctcagatgaccatcctccaaggctatgtaatcagttgcactcagagattagtagctagagagtgcagttcctgttggctttgcctcccgcttccctcagttcccttggccctcactgctgcttcctgggtttgcatcttctaacaaggataggaggcatatgggcttttgctccaag

SEQ ID NO: 106939 - DNA, 201 bp, Bos taurus; identical to SEQ ID NO: 25887

SEQ ID NO: 106940 - DNA, 201 bp, Bos taurus; identical to SEQ ID NO: 25889

SEQ ID NO: 106941 - DNA, 201 bp, Bos taurus; identical to SEQ ID NO: 25891

SEQ ID NO: 106942 - DNA, 201 bp, Bos taurus
caggagtgtgtcggcaggagtgaactccccgacacccgagcgaaagttacaggcgagacagggcgagtcctatcaactgaggccgccactagaacagaaagttaatgttctaaacagtaaacagctgggcttctcgaaaggaaaaccacttcctgttgggccgctatcttgcctccatcccaaatcccaaaccctctgcac

SEQ ID NO: 106943 - DNA, 201 bp, Bos taurus
gagtggggagcctggcacaggggccctcacgtatccgggctgcagaaaaagagccctttcttctctgtggcggcccctgccagaggccgctccgcaatctgggagctattccaagggctcccagtgttgtcaatgtcagagttaacagggagcctgggccaccatcattatgctggtctttaggctcagctgcagatggaa

SEQ ID NO: 106944 - DNA, 201 bp, Bos taurus
aggacaaataaatgccttcttctctaactggtcaggtatctccaagaaaccctataggttctctttaactcctgcaccttgctcaagcccgaaccaaatcaaagcggggctggctacccctggggcctgtctgtgtaccatccctgatgcaggcatttcccaaggctcagaaagtacctgacagaagcattgcccctactt

SEQ ID NO: 106945 - DNA, 201 bp, Bos taurus; identical to SEQ ID NO: 25894

SEQ ID NO: 106946 - DNA, 201 bp, Bos taurus
gaggttttaagagcagaagaaatattacagaagagtcagtgaagttgaaggtaaatcaatagaaattatccaacctgaaggacatacgcattgaaaaaaacgaacagtacttcaaggacaggcggggcaacatcaaaatgtctgcgttcgtgctaagttgcttcagtcgtgtctaactcttagcaaccccatggactgtag

SEQ ID NO: 106947 - DNA, 201 bp, Bos taurus
ggtgtgatcccacagaagagtagtaagaaagtttctccagggaaacagcatattgggtatgatcaaaggttgatgatgtcacgtgtgatttctgagcaccgctggggctgatcagcaggcctcccttcacgaggcaacttgccaggctggggcccagccccctaccccggggcacacccgtggctctacttggggccagag

SEQ ID NO: 106948 - DNA, 201 bp, Bos taurus
ttttctccctgtcactggccaagggaatcattctagaagcacacaaatggtcatcttactgtgtcagcctgtggctcccgagacgcctataaatttagaaggtacgagggccactcaggacaagagacgtgcagcagtcttcttgcctagatactgcagcagcctgccttgtgtagagttgtttagtatttctttcctttt

SEQ ID NO: 106949 - DNA, 201 bp, Bos taurus; identical to SEQ ID NO: 25896

SEQ ID NO: 106950 - DNA, 201 bp, Bos taurus; identical to SEQ ID NO: 25897

SEQ ID NO: 106951 - DNA, 201 bp, Bos taurus; identical to SEQ ID NO: 25898

SEQ ID NO: 106952 - DNA, 201 bp, Bos taurus; identical to SEQ ID NO: 25899

SEQ ID NO: 106953 - DNA, 201 bp, Bos taurus; identical to SEQ ID NO: 25900

SEQ ID NO: 106954 - DNA, 201 bp, Bos taurus; identical to SEQ ID NO: 25903

SEQ ID NO: 106955 - DNA, 201 bp, Bos taurus; identical to SEQ ID NO: 25905

SEQ ID NO: 106956 - DNA, 201 bp, Bos taurus; identical to SEQ ID NO: 25909

SEQ ID NO: 106957 - DNA, 201 bp, Bos taurus; identical to SEQ ID NO: 25911

SEQ ID NO: 106958 - DNA, 201 bp, Bos taurus; identical to SEQ ID NO: 25913

SEQ ID NO: 106959 - DNA, 201 bp, Bos taurus; identical to SEQ ID NO: 25914

SEQ ID NO: 106960 - DNA, 201 bp, Bos taurus; identical to SEQ ID NO: 25915

SEQ ID NO: 106961 - DNA, 201 bp, Bos taurus; identical to SEQ ID NO: 25920

SEQ ID NO: 106962 - DNA, 201 bp, Bos taurus; identical to SEQ ID NO: 25921

SEQ ID NO: 106963 - DNA, 201 bp, Bos taurus; identical to SEQ ID NO: 25922

SEQ ID NO: 106964 - DNA, 201 bp, Bos taurus; identical to SEQ ID NO: 25923

SEQ ID NO: 106965 - DNA, 201 bp, Bos taurus; identical to SEQ ID NO: 25924

SEQ ID NO: 106966 - DNA, 201 bp, Bos taurus; identical to SEQ ID NO: 25927

SEQ ID NO: 106967 - DNA, 201 bp, Bos taurus; identical to SEQ ID NO: 25929

SEQ ID NO: 106968 - DNA, 201 bp, Bos taurus; identical to SEQ ID NO: 25934

SEQ ID NO: 106969 - DNA, 201 bp, Bos taurus; identical to SEQ ID NO: 25937

SEQ ID NO: 106970 - DNA, 201 bp, Bos taurus; identical to SEQ ID NO: 25944

SEQ ID NO: 106971 - DNA, 201 bp, Bos taurus; identical to SEQ ID NO: 25945

SEQ ID NO: 106972 - DNA, 201 bp, Bos taurus; identical to SEQ ID NO: 25946

SEQ ID NO: 106973 - DNA, 201 bp, Bos taurus; identical to SEQ ID NO: 25947

SEQ ID NO: 106974 - DNA, 201 bp, Bos taurus; identical to SEQ ID NO: 25948

SEQ ID NO: 106975 - DNA, 201 bp, Bos taurus; identical to SEQ ID NO: 25949

SEQ ID NO: 106976 - DNA, 201 bp, Bos taurus; identical to SEQ ID NO: 25952

SEQ ID NO: 106977 - DNA, 201 bp, Bos taurus; identical to SEQ ID NO: 25953

SEQ ID NO: 106978 - DNA, 201 bp, Bos taurus; identical to SEQ ID NO: 25956

SEQ ID NO: 106979 - DNA, 201 bp, Bos taurus; identical to SEQ ID NO: 25964

SEQ ID NO: 106980 - DNA, 201 bp, Bos taurus; identical to SEQ ID NO: 25966

SEQ ID NO: 106981 - DNA, 201 bp, Bos taurus; identical to SEQ ID NO: 25969

SEQ ID NO: 106982 - DNA, 201 bp, Bos taurus; identical to SEQ ID NO: 25970

SEQ ID NO: 106983 - DNA, 201 bp, Bos taurus; identical to SEQ ID NO: 25971

SEQ ID NO: 106984 - DNA, 201 bp, Bos taurus; identical to SEQ ID NO: 25972

SEQ ID NO: 106985 - DNA, 201 bp, Bos taurus; identical to SEQ ID NO: 25973

SEQ ID NO: 106986 - DNA, 201 bp, Bos taurus; identical to SEQ ID NO: 25974

SEQ ID NO: 106987 - DNA, 201 bp, Bos taurus; identical to SEQ ID NO: 25975

SEQ ID NO: 106988 - DNA, 201 bp, Bos taurus; identical to SEQ ID NO: 25976

SEQ ID NO: 106989 - DNA, 201 bp, Bos taurus; identical to SEQ ID NO: 25979

SEQ ID NO: 106990 - DNA, 201 bp, Bos taurus; identical to SEQ ID NO: 25981

SEQ ID NO: 106991 - DNA, 201 bp, Bos taurus; identical to SEQ ID NO: 25982

SEQ ID NO: 106992 - DNA, 201 bp, Bos taurus; identical to SEQ ID NO: 25983

SEQ ID NO: 106993 - DNA, 201 bp, Bos taurus; identical to SEQ ID NO: 25984

SEQ ID NO: 106994 - DNA, 201 bp, Bos taurus; identical to SEQ ID NO: 25985

SEQ ID NO: 106995 - DNA, 201 bp, Bos taurus; identical to SEQ ID NO: 25986

SEQ ID NO: 106996 - DNA, 201 bp, Bos taurus; identical to SEQ ID NO: 25987

SEQ ID NO: 106997 - DNA, 201 bp, Bos taurus; identical to SEQ ID NO: 25988

SEQ ID NO: 106998 - DNA, 201 bp, Bos taurus; identical to SEQ ID NO: 25989

SEQ ID NO: 106999 - DNA, 201 bp, Bos taurus; identical to SEQ ID NO: 25993

SEQ ID NO: 107000 - DNA, 201 bp, Bos taurus; identical to SEQ ID NO: 25997

SEQ ID NO: 107001 - DNA, 201 bp, Bos taurus; identical to SEQ ID NO: 25998

SEQ ID NO: 107002 - DNA, 201 bp, Bos taurus; identical to SEQ ID NO: 25999

SEQ ID NO: 107003 - DNA, 201 bp, Bos taurus; identical to SEQ ID NO: 26001

SEQ ID NO: 107004 - DNA, 201 bp, Bos taurus; identical to SEQ ID NO: 26002

SEQ ID NO: 107005 - DNA, 201 bp, Bos taurus; identical to SEQ ID NO: 26003

SEQ ID NO: 107006 - DNA, 201 bp, Bos taurus; identical to SEQ ID NO: 26004

SEQ ID NO: 107007 - DNA, 201 bp, Bos taurus; identical to SEQ ID NO: 26005

SEQ ID NO: 107008 - DNA, 201 bp, Bos taurus; identical to SEQ ID NO: 26007

SEQ ID NO: 107009 - DNA, 201 bp, Bos taurus; identical to SEQ ID NO: 26009

SEQ ID NO: 107010 - DNA, 201 bp, Bos taurus; identical to SEQ ID NO: 26010

SEQ ID NO: 107011 - DNA, 201 bp, Bos taurus
tagcaggtactgtgcatgttaataccttacgtctagcgtgcagcttccttatcctggttgacagaaggcagacaaggaatcgagatggaccctaagcaattgctgctgcccaacagcactgaaactccatctccaacccgtgggtgagaagccctgcccaggacagcgcccaggggagcctcctcacaagggccaggtcac

SEQ ID NO: 107012 - DNA, 201 bp, Bos taurus
gctttaagataaaagcttgtatttgcatgggccgcttacatctgaaactgatatttcctcctaacaagctgaaaacaatttcaataaaagcaatagaactgttcttttctattaatgtgctgtgcttagttactcagttctgtcccactctttgagaccccatggactatagcctgccaggctcctctgtccatggggatt

SEQ ID NO: 107013 - DNA, 201 bp, Bos taurus; identical to SEQ ID NO: 66181

SEQ ID NO: 107014 - DNA, 201 bp, Bos taurus; identical to SEQ ID NO: 26012

SEQ ID NO: 107015 - DNA, 201 bp, Bos taurus; identical to SEQ ID NO: 26014

SEQ ID NO: 107016 - DNA, 201 bp, Bos taurus
cttccagaaagggctgacaggtatgtactgagccagatggaggtggaacaagatgagactggaaatgtagacagggccagacggccccgggactttgtaggttaggtcaagagtttagattttttttttttttgatatttaaaaatgtattttaaaatatttatggaaaaggaatcttagaaagtgaattttttctcctgt

SEQ ID NO: 107017 - DNA, 201 bp, Bos taurus
tcgccgttaagatgcatttctcacactgcacttctttttccgcttagataaaaatgcaaatttcttagcgtggcttgccctggccctcttctcgggctaatctccttttttttaaaaatatttttgttgtagttgatttaccatgttgtgtcagtttctatgttgtagccacgcgttccgggaaacaaactcgctcagaag

SEQ ID NO: 107018 - DNA, 201 bp, Bos taurus; identical to SEQ ID NO: 26015

SEQ ID NO: 107019 - DNA, 201 bp, Bos taurus; identical to SEQ ID NO: 26017

SEQ ID NO: 107020 - DNA, 201 bp, Bos taurus; identical to SEQ ID NO: 26019

SEQ ID NO: 107021 - DNA, 201 bp, Bos taurus; identical to SEQ ID NO: 26021

SEQ ID NO: 107022 - DNA, 201 bp, Bos taurus; identical to SEQ ID NO: 26022

SEQ ID NO: 107023 - DNA, 201 bp, Bos taurus; identical to SEQ ID NO: 26023

SEQ ID NO: 107024 - DNA, 201 bp, Bos taurus
tctgtgtcgcagctgctcctcttttgcatgaaagcatcccagacggtacctaaggatgactgtggctgtatcaacacacccttatttacacaaacaggctcggggctggatggccatagtctgcccacctctgacctggagaattttctgtaccagctcctgcagtacataaagtcaagctgctctctcacaaaagggcag

SEQ ID NO: 107025 - DNA, 201 bp, Bos taurus; identical to SEQ ID NO: 26024

SEQ ID NO: 107026 - DNA, 201 bp, Bos taurus; identical to SEQ ID NO: 26026

SEQ ID NO: 107027 - DNA, 201 bp, Bos taurus; identical to SEQ ID NO: 26027

SEQ ID NO: 107028 - DNA, 201 bp, Bos taurus
ccctcctgggacaccaccaactccagatgtctctgggagtctgtggtggccccattccagactctgtaccccacctggctcacctcctttctcatcatcccctctgagaggggaggggggccagggaggaaaagtcctcatcaagctccatgtggaagaggggagcaggaagagtttcagtggactaacccttgtagggtt

SEQ ID NO: 107029 - DNA, 201 bp, Bos taurus
ataaccaacgtttttcctatttttaaaaagcatatattcttggtcttgtggctttttctctcctcaacttctggcttactttttcctcttaatttcatttttttatacttttcttccagttcttcattccgtatagcatatgttacttactatgacttttgtgaggcttccattcttcttccgtgtctagttatttccccc

SEQ ID NO: 107030 - DNA, 201 bp, Bos taurus
gagcaaggccttataagtgcaatgaatgtgggaaatcttttcttactaactcccatctccatcgtcatcagagagttcacactgaagaaaggccttatgcatgtggtgagtgtggaaaatcttttgccagtagcactagtctccgtcttcatgaaggcactcacactgaaaggcctattgagtgcagtgaatgtgggaaat

SEQ ID NO: 107031 - DNA, 201 bp, Bos taurus; identical to SEQ ID NO: 26028

SEQ ID NO: 107032 - DNA, 201 bp, Bos taurus; identical to SEQ ID NO: 26029

SEQ ID NO: 107033 - DNA, 201 bp, Bos taurus; identical to SEQ ID NO: 26030

SEQ ID NO: 107034 - DNA, 201 bp, Bos taurus; identical to SEQ ID NO: 26031

SEQ ID NO: 107035 - DNA, 201 bp, Bos taurus; identical to SEQ ID NO: 26032

SEQ ID NO: 107036 - DNA, 201 bp, Bos taurus; identical to SEQ ID NO: 26034

SEQ ID NO: 107037 - DNA, 201 bp, Bos taurus; identical to SEQ ID NO: 26035

SEQ ID NO: 107038 - DNA, 201 bp, Bos taurus; identical to SEQ ID NO: 26038

SEQ ID NO: 107039 - DNA, 201 bp, Bos taurus; identical to SEQ ID NO: 26041

SEQ ID NO: 107040 - DNA, 201 bp, Bos taurus; identical to SEQ ID NO: 26044

SEQ ID NO: 107041 - DNA, 201 bp, Bos taurus; identical to SEQ ID NO: 26048

SEQ ID NO: 107042 - DNA, 201 bp, Bos taurus; identical to SEQ ID NO: 26050

SEQ ID NO: 107043 - DNA, 201 bp, Bos taurus; identical to SEQ ID NO: 26052

SEQ ID NO: 107044 - DNA, 201 bp, Bos taurus; identical to SEQ ID NO: 26054

SEQ ID NO: 107045 - DNA, 201 bp, Bos taurus; identical to SEQ ID NO: 26055

SEQ ID NO: 107046 - DNA, 201 bp, Bos taurus; identical to SEQ ID NO: 26058

SEQ ID NO: 107047 - DNA, 201 bp, Bos taurus; identical to SEQ ID NO: 26060

SEQ ID NO: 107048 - DNA, 201 bp, Bos taurus; identical to SEQ ID NO: 26065

SEQ ID NO: 107049 - DNA, 201 bp, Bos taurus; identical to SEQ ID NO: 26066

SEQ ID NO: 107050 - DNA, 201 bp, Bos taurus; identical to SEQ ID NO: 26067

SEQ ID NO: 107051 - DNA, 201 bp, Bos taurus; identical to SEQ ID NO: 26068

SEQ ID NO: 107052 - DNA, 201 bp, Bos taurus; identical to SEQ ID NO: 26069

SEQ ID NO: 107053 - DNA, 201 bp, Bos taurus; identical to SEQ ID NO: 26070

SEQ ID NO: 107054 - DNA, 201 bp, Bos taurus; identical to SEQ ID NO: 26071

SEQ ID NO: 107055 - DNA, 201 bp, Bos taurus
gacagctctgtgtccttggtggcttctctctcaggtcctttcttggggacagtgagaatatatttctgcccttcaataacatggggcagaaaagtgctcgctttatatacatgatctctagtgatgctcatttctacaggatgtcccatggagagggactctttccatatcttgggacgtgtaaacctggatcagcaagag

SEQ ID NO: 107056 - DNA, 201 bp, Bos taurus; identical to SEQ ID NO: 26072

SEQ ID NO: 107057 - DNA, 201 bp, Bos taurus; identical to SEQ ID NO: 26073

SEQ ID NO: 107058 - DNA, 201 bp, Bos taurus; identical to SEQ ID NO: 26074

SEQ ID NO: 107059 - DNA, 201 bp, Bos taurus
atgacctcatttttataaccttccttattataaattatccctccatcacagcagggaccagcatggctttttacaaccatttagcggcagcgtactcctccgaggcccaagtcaccatggaaacttccccagtatacagttctagagacatccgtgtacaccaaatgggcaaccaacattttcaagaatgactgccctcag

SEQ ID NO: 107060 - DNA, 201 bp, Bos taurus
ctcgctccagcccagggtcttcaaaacaaagccatggagaaagaaaaaccagtctgtcaggaccttttggaagtcacatttcaggccaaagcaagctcccgaggagtctgtgtgccccataccctccactaggaaagctgaaaagtaggaagggacagacaaggccttgcatatcaaggtcccagaggggagcggtcccca

SEQ ID NO: 107061 - DNA, 201 bp, Bos taurus; identical to SEQ ID NO: 26075

SEQ ID NO: 107062 - DNA, 201 bp, Bos taurus; identical to SEQ ID NO: 26076

SEQ ID NO: 107063 - DNA, 201 bp, Bos taurus; identical to SEQ ID NO: 26077

SEQ ID NO: 107064 - DNA, 201 bp, Bos taurus
cttataatcttatctggctaaccataaatcaaattatgaagcatttcgatgctatacatggtatcctcataaaatatatgagactagtagttggcaaatttgatttctaggttctttcaaaccaattacagagaaaatagagctagaccttttcctgaggcaaaacgctttaagtctctgagttctagtttccatcctgct

SEQ ID NO: 107065 - DNA, 201 bp, Bos taurus; identical to SEQ ID NO: 26078

SEQ ID NO: 107066 - DNA, 201 bp, Bos taurus; identical to SEQ ID NO: 26079

SEQ ID NO: 107067 - DNA, 201 bp, Bos taurus
cggcagccgcggccgcggccgcagcgctggtggctggcagagccgaggccgccgctgcagcggccgccatgtaggtgtagggataggggaagaggcctccaaaagtgggcatggggattccctgaaagaaacaaaacaagacaagggttaggcatcccgcctggggtgttcctgggggtgatctgggtgctggtggccggg

SEQ ID NO: 107068 - DNA, 201 bp, Bos taurus; identical to SEQ ID NO: 26080

SEQ ID NO: 107069 - DNA, 201 bp, Bos taurus
gttgatgtcattccatttcttctgaaggagtaagactacgctccactctcaccccagggttttttctcctttcttccacccagggccaagaccctggctccgagaaggctgtgggcagctaggactctggctcacttccaccatctctaggggtgtgggtccagcttggcctgggacagactggagagaggatgctttcag

SEQ ID NO: 107070 - DNA, 201 bp, Bos taurus
ctcacaataataatgccactaataatagctattaggaaactgaatctctttttaaaaagacagctttatcgagctttacctgacacattatacaaaccattcttttgaagtgtataaatcaatgtgcatcaagtcttctaatacataatttaacattatccagcaccctttaagggctgtgacgacgtaaggttctagggt

SEQ ID NO: 107071 - DNA, 201 bp, Bos taurus
attgaatccatatattgtatttacgttctctgtcaaggttgcttttccacatttgagagatcaaaggccaaaacagtcatcaaccctgtagccttcaatattgtgttcattacatttaatcaagtgccaactccatggtatcattcaccaaccttaacaatatttaaatgcatggcattgtttagcaacaaatgtaggcac

SEQ ID NO: 107072 - DNA, 201 bp, Bos taurus; identical to SEQ ID NO: 26081

SEQ ID NO: 107073 - DNA, 201 bp, Bos taurus; identical to SEQ ID NO: 26082

SEQ ID NO: 107074 - DNA, 201 bp, Bos taurus; identical to SEQ ID NO: 26083

SEQ ID NO: 107075 - DNA, 201 bp, Bos taurus; identical to SEQ ID NO: 26084

SEQ ID NO: 107076 - DNA, 201 bp, Bos taurus; identical to SEQ ID NO: 26085

SEQ ID NO: 107077 - DNA, 201 bp, Bos taurus; identical to SEQ ID NO: 26086

SEQ ID NO: 107078 - DNA, 201 bp, Bos taurus
cagtgagcatttgtttggaggaagtgtagggaatgagagaacattcacaggttccagcatttattgaactcttactatatcccaggccacgctgggctcttacatcatctgtctccagttcacaacgacctcaaaaggtaggtactcttattacctccttcttcagaaaaaggtgcccctcacaggtggccacaaagggag

SEQ ID NO: 107079 - DNA, 201 bp, Bos taurus
ctggaggtattagccatgggtcaagttcggaggtcagaggtcaaacaggttgtcatcagtttctcacagctatcagagcaagggcaggggaggggccaaataaaacccaccaacaacacagctggttcttattagccaaatcctgcctccctgtaaagagagatgggtcagtcaggtccacacccaccccagggacacccc

SEQ ID NO: 107080 - DNA, 201 bp, Bos taurus
tttataaattatatttatttttaagtaggcattgcattcacatggctcaaaattcaaaagacactaatgacgctatagaaaaaatcgtcctttccaccccgtacccctgccacccagttccctgtcccataggcaaccagtattgtcagcgaaattccccccttgttaattacttagttgccttaggtgacaaatccgtga

SEQ ID NO: 107081 - DNA, 201 bp, Bos taurus; identical to SEQ ID NO: 26087

SEQ ID NO: 107082 - DNA, 201 bp, Bos taurus; identical to SEQ ID NO: 26088

SEQ ID NO: 107083 - DNA, 201 bp, Bos taurus; identical to SEQ ID NO: 26089

SEQ ID NO: 107084 - DNA, 201 bp, Bos taurus
aaatggtggacaaatgctcctccctgaagtgtttttttttttttacactgggtgttcatgttttattttgagagagagggaggggaggggaggaagacacggggaatgctcacattgctactaacatttttaaaactaacattttggaatagtgtttatgaaaatcttgaactggcttttaaacagtttcaagtttcaaca

SEQ ID NO: 107085 - DNA, 201 bp, Bos taurus
tttagttggaggaggcagaaggccatggaatagtgccaagacataccgtgggacgtggtcatcattaaaaaaaacattaaatgcgcacagaagatggcaagtacaactggagccttcgggccacacaagggagagggcagcacccaggagaacctcctatgcatatcaccccatatacagtgaccctatacagccaacatt

SEQ ID NO: 107086 - DNA, 201 bp, Bos taurus
tggcctaaaacaacacagatgtattctcttacctttctggaggtcagaagtctgaaatgggtctctaccgggttgaaatcaaggaatctgccttccttttttggaggctcgaagggaagatccattttcttgtcttttttttgacttctagaggttgtgccacattccttatctgtagccagcaatggacagtcaaatctt

SEQ ID NO: 107087 - DNA, 201 bp, Bos taurus; identical to SEQ ID NO: 26090

SEQ ID NO: 107088 - DNA, 201 bp, Bos taurus; identical to SEQ ID NO: 26091

SEQ ID NO: 107089 - DNA, 201 bp, Bos taurus; identical to SEQ ID NO: 26092

SEQ ID NO: 107090 - DNA, 201 bp, Bos taurus; identical to SEQ ID NO: 26093

SEQ ID NO: 107091 - DNA, 201 bp, Bos taurus; identical to SEQ ID NO: 26094

SEQ ID NO: 107092 - DNA, 201 bp, Bos taurus
ttctttcttgtcaagtgaacacacaggggaagcaaggacttcatcttttgttttctttgtctagcaccactgccagttctagcctgtcagggcaaattcagtaataattaatagctgttgatgagccagttgttctagaatccatttttttttttaataagctgaccaataaatgagacttgccataaatttaaggattct

SEQ ID NO: 107093 - DNA, 201 bp, Bos taurus
cctgtgtctcctgcttgacaggcagattctttaccactgagcctcacctggaagcccagctaaaagcaacagagcacagttacaactgaaacagcagtgggtaacagcagggagacaagttctagccccactgccgatgctgtgtggcctagggagccctgtttcttccctgggcctcagctctctgtcagtgcaggaagg

SEQ ID NO: 107094 - DNA, 201 bp, Bos taurus
aaagccccctggcagcaatatagacccagcacagccaaaaacaaatacgtgcatgttaaaaaaaataaatattaagcttgattagagctccaaggaaccccttaatgatctttgactcagatgccagatacagttgaatgaagtgtgaaagctggcagttgcctgaccttggagaagtgggagctgccaccaaggagaagg

SEQ ID NO: 107095 - DNA, 201 bp, Bos taurus; identical to SEQ ID NO: 26095

SEQ ID NO: 107096 - DNA, 201 bp, Bos taurus; identical to SEQ ID NO: 26096

SEQ ID NO: 107097 - DNA, 201 bp, Bos taurus; identical to SEQ ID NO: 26097

SEQ ID NO: 107098 - DNA, 201 bp, Bos taurus; identical to SEQ ID NO: 26098

SEQ ID NO: 107099 - DNA, 201 bp, Bos taurus
ccccctgattgaaatgtgtccctgtcgcactgaggccagctctggtggggagagggtgggagacttctggtcccccgtgcctggcctgtaggctccttccatctgcggaagatagatgacgttattccaagccaagatgatgcaaccaaggtcagagtgaagtgtttaattggaatgtcaggggccggggcctggctctgc

SEQ ID NO: 107100 - DNA, 201 bp, Bos taurus; identical to SEQ ID NO: 26099

SEQ ID NO: 107101 - DNA, 201 bp, Bos taurus
cttgcgagataaatgcctaattgataacaatctgggagcccatagcttgaggatctatgggcatatagagtctgtaggcctcacaaagtctcttgtaaaatttggaaggtgactcgtttcccttctgaactattccagccagtttagacatggccgttggcctccgctccccttttaagtccttgtataatcgctgtcccg

SEQ ID NO: 107102 - DNA, 201 bp, Bos taurus
cctcatttccagtctcctctcatgatggcctgacccctgctatttctctcccgcatatacactcccatctcttcctgcagcggttccatgcacattgcagtgtttggccagcctcacaggatgcttgctgcctgccagctcttataccacaggctgttgttgctccttcagacaggattctgcctgcttctgatgaaatcc

SEQ ID NO: 107103 - DNA, 201 bp, Bos taurus
tgagcaacgcgatagccttgagtacacgtgggacagagcgggatctaggatctgggcttagtctcctctcggggggccttctctctgagcagtgctgcccgtcccagggtctcctgcagcaagaacgaagtgctgcccatcggaagccccagaggcccctcgctggccagcttggtatggcttctattcagcaaaagacat

SEQ ID NO: 107104 - DNA, 201 bp, Bos taurus
gtggggggagtctgtgcacaccccacactgcttgacttgtgggcaatgactaaaggatcaggaaggtgagagggaggaggccccttccatcactggggctgaaaccaaggctgagcagagatcatcacccagcatgcctccccgtaagccctgagcgaggttgatatccagggaggccaggccagctctctattgttgatt

SEQ ID NO: 107105 - DNA, 201 bp, Bos taurus
tgtgggatgtgtacattggtacagaaaggtggcaatttcactcctaggtatttacctgagaaagatctttatacgtgtaccaaaaggaatgcacaaagcatttctatatgtaatggccccaaactggagacggcctagaagttcatcagcattggaatggataaatcaattattatgtaattatacattggagcactatac

SEQ ID NO: 107106 - DNA, 201 bp, Bos taurus
agcccggctcctcatctacgtagctgctctctgttcccacacccctgtgcttccctgtgtaatgacatccaccatgctggactataatggccaacctacccgtccattctccccatagactgtgagcctagccctggctgtggcacttcacgagcactcaatatggtttctgtgcagtcgcttattcaatgaactgatgtc

SEQ ID NO: 107107 - DNA, 201 bp, Bos taurus; identical to SEQ ID NO: 26100

SEQ ID NO: 107108 - DNA, 201 bp, Bos taurus; identical to SEQ ID NO: 26101

SEQ ID NO: 107109 - DNA, 201 bp, Bos taurus; identical to SEQ ID NO: 26102

SEQ ID NO: 107110 - DNA, 201 bp, Bos taurus; identical to SEQ ID NO: 26103

SEQ ID NO: 107111 - DNA, 201 bp, Bos taurus; identical to SEQ ID NO: 26104

SEQ ID NO: 107112 - DNA, 201 bp, Bos taurus; identical to SEQ ID NO: 26105

SEQ ID NO: 107113 - DNA, 201 bp, Bos taurus; identical to SEQ ID NO: 26106

SEQ ID NO: 107114 - DNA, 201 bp, Bos taurus; identical to SEQ ID NO: 26107

SEQ ID NO: 107115 - DNA, 201 bp, Bos taurus; identical to SEQ ID NO: 26108

SEQ ID NO: 107116 - DNA, 201 bp, Bos taurus
tattgacatctcacagtccacctagaattgatttttgtgtatgtgcaaggcaacagctcagggtttatttttttcccatataaacaattggcccaacatcacatattgaaaagaccatctttccccacttgctcttcagcactacatttgttataaatcagagtggccatatgtctctttctagtttctctactccgttct

SEQ ID NO: 107117 - DNA, 201 bp, Bos taurus
cctaggaaactactgtttcgtgggtccgattgtgtaggtcacatgacgctgaggtgaggtttctttgtctctggtgtttgtaccagtggtttcccaggccggtttgctttgcagaggtgatgaaagtggctgacctgacttttggtttgtatctcatgctcagcagtgactacctgctggtagtaagcttttctgcccact

SEQ ID NO: 107118 - DNA, 201 bp, Bos taurus; identical to SEQ ID NO: 26109

SEQ ID NO: 107119 - DNA, 201 bp, Bos taurus; identical to SEQ ID NO: 26110

SEQ ID NO: 107120 - DNA, 201 bp, Bos taurus; identical to SEQ ID NO: 26111

SEQ ID NO: 107121 - DNA, 201 bp, Bos taurus; identical to SEQ ID NO: 26112

SEQ ID NO: 107122 - DNA, 201 bp, Bos taurus
tggcatctggaatcttcccagagcagagagagagccatggcctctgcactggcaggcaattcttaaccagtggaccaccaaggaagtctccatctcttatatctgttctcggcccctctgaggggctcctaagaatcccaaattgctccttcaagtagttttgttattgcctgtttccttctctttcttcttctctggacc

SEQ ID NO: 107123 - DNA, 201 bp, Bos taurus; identical to SEQ ID NO: 26113

SEQ ID NO: 107124 - DNA, 201 bp, Bos taurus
ttggagaccagaagattttttttttaagttttcagaggtggggcatttgctgtgttttattaaagcaattcatgcttgaatagactaaaaacattttactcttttcatcattttctaccttcagtgtaagacgatttcaaaaagtaagactggtctagtatcacctaaacaaagaaggggctttgttttttatcattttaa

SEQ ID NO: 107125 - DNA, 201 bp, Bos taurus; identical to SEQ ID NO: 26114

SEQ ID NO: 107126 - DNA, 201 bp, Bos taurus; identical to SEQ ID NO: 26115

SEQ ID NO: 107127 - DNA, 201 bp, Bos taurus
gatatactaatttggaatatatttttgtaatgtaagattttttttcactaaacaagttttttaatagcttttaaaagtcactatagtttttttaaattaatatgttttgttttttttcccaagatatttatggtttaagattcaaaagctacaaaagggcttacaagattttttcttttatctgtttccctagtcactcag

SEQ ID NO: 107128 - DNA, 201 bp, Bos taurus; identical to SEQ ID NO: 26116

SEQ ID NO: 107129 - DNA, 201 bp, Bos taurus
tcaacctgagaaacggaagcggggcctgccccagctccctgccacccctcacttaaacagaccagtgcctgaactgaaggggcttagcagaagctgagccgatgctcagcacgccctggccaacgctccccaagcaggagcaagcaatagggtgtggtgaagagtcatcgtttatcttcctctctggatgcctctttaaaa

SEQ ID NO: 107130 - DNA, 201 bp, Bos taurus
gagagcaggagcctgggtgggctgtcaggggtccgggctccactcttcctgtgcagcttggataatcttcttcccttctctgtgtctcagtttccctctcctgagaggggttgggccaggtggtatctgagggtcactccatcctgagaccccagggagtgcctgtccttccagacctgggggcagcctcggccctccccc

SEQ ID NO: 107131 - DNA, 201 bp, Bos taurus
gttgtggcagtgaaagcgaggctgtgggatggaggagaagaggcgggagacagacagagacagaggggaagggaagacagccagaggcctgaacacgcagcgcttctggtccctacagaataaggcaccagagtcagtgacgttcccgttgtccctgtggtattaaaacgggtgctgaaggtgggggcggtggctgctgaa

SEQ ID NO: 107132 - DNA, 201 bp, Bos taurus
cccaatattcggttggccaggggagaagtggggctcttggaggtgtccggaggagttctctatgccgacaaggcactcagagccctccaggtgacatggtacatcgttaggggccacacagctcctgctctgggcatcctgggtccccatcagccatcccctgacctccggccggatgagcgcctttgccctgctgcttct

SEQ ID NO: 107133 - DNA, 201 bp, Bos taurus
gtatcaggaagaaaagccaacttcccctgggaggtgggggcacttgggcacattaagcacttgtcccagggggatggatactcattctctcagggcaccaaccctgggccagagccttcccacagagagagggggaaaggaggtgggatccaagcagaggagggagatcagcaacctggcaaaattgccggttcttcaatc

SEQ ID NO: 107134 - DNA, 201 bp, Bos taurus
ccaggttgtgctgttaggccttgaacaagtaccagcaggcatgcccatcaaaggtttgtgttccagacactcctttgtgagttgctggtttggaacttgcagtgcattttcaacccacagaaggaaatgttgcaaatggtggttaacctcctaagctagtttacaaaacccttgtttaaccaaaagatactaaaacatcta

SEQ ID NO: 107135 - DNA, 201 bp, Bos taurus; identical to SEQ ID NO: 26117

SEQ ID NO: 107136 - DNA, 201 bp, Bos taurus
tgcctggacaagcccatgcacagaggggcctggagggctacagtccatggagtcgtgaaaaagtaggacacatctgagcgtgcacacaccatctgccagccctctcctgggcctcggtcattaactgtgtgccaggcagacttaagacagactctttcttgggcttctgtacaactcaacttgtgtacactctctagacac

SEQ ID NO: 107137 - DNA, 201 bp, Bos taurus; identical to SEQ ID NO: 26118

SEQ ID NO: 107138 - DNA, 201 bp, Bos taurus
acaggcgggggtgggtcaaggtcgcggcccagggccccctcgcctcctaggtgcgtggtcttctgagcagtggaccccgctgcagcccaagccctcagccacccaaggggcccttggccccgcctcacctcccacgcaggccaatgcagccttgaaggcacagctttccatcgccctctcgatcatcttctgctcctcact

SEQ ID NO: 107139 - DNA, 201 bp, Bos taurus
taaatacccacatgtttgaaactttgtggatgagatgagtcaatacagtaagcgcgtgagccgatacgctttgaaacttaacttccacagcttcccaagcattgaaatggacagcttgaacagaggtagagagagaggtgactagaggagtgggttagaagaagaaaaagtttgcatgtgaaatttcaagagtggccagac

SEQ ID NO: 107140 - DNA, 201 bp, Bos taurus; identical to SEQ ID NO: 26119

SEQ ID NO: 107141 - DNA, 201 bp, Bos taurus
ctcaaaattctgtgagtttgctgtctgttatctaaccgatcgcacgagcaaagagccaccatgaaggagaggaggcaaatgtagcaactaggagaattggtactcaaggaactagaaataatactgagactgtgaaagaaatgtttgaatttttaatttactgttcatttttttgacggcaccatgcagcttatgggatct

SEQ ID NO: 107142 - DNA, 201 bp, Bos taurus; identical to SEQ ID NO: 26120

SEQ ID NO: 107143 - DNA, 201 bp, Bos taurus; identical to SEQ ID NO: 26121

SEQ ID NO: 107144 - DNA, 201 bp, Bos taurus
acaatctacgtgcccttctcctgcctattgggtactgccgcatcatgtcccctcccagcctctgcagctaccattcttcccctgggagggccccacttcctgtccctggagtcagtagtggttgttaggtgcagttttctgggtcagagccttagacctctgagtcccagtgacatataaacagagactgaattttggcca

SEQ ID NO: 107145 - DNA, 201 bp, Bos taurus
tattttcagatccttctgtaaatttttgttgactcaaggctcaaccctaggccctcttctcccaaaacaataaaattaccgtctctatgtcagttgctcaaaagttttattttttgtccagggccagctttactctgaaagacaaacctctatcatctgtgtacttgatatctcaaagacatgttccaacatgttccaaag

SEQ ID NO: 107146 - DNA, 201 bp, Bos taurus
aaacccttcaggcattctcctggaagactccccttcagtagagcaggagtccccaactcctgggctacagaccagtactgatccacagcttgttaggaactgggccacacagccagaaatgggctgctccctgttgcttgcattgctgcctgaatcatcctgtctgtggaaaactagtcttctaccagaatggtccctggt

SEQ ID NO: 107147 - DNA, 201 bp, Bos taurus; identical to SEQ ID NO: 26122

SEQ ID NO: 107148 - DNA, 201 bp, Bos taurus
gagggccgccctcagccccgcccttgaccccgccctgcgccctgccctggcccacctgcgtcttgtagatggtgtagccttccttctcatgctgcagggctgagcggaactcggctttgctctcatagacccgggcgaccaggtggtggctgtagggaggcagggcgcagggtggggggcgagggagggcgtgaacgggcc

SEQ ID NO: 107149 - DNA, 201 bp, Bos taurus; identical to SEQ ID NO: 26123

SEQ ID NO: 107150 - DNA, 201 bp, Bos taurus; identical to SEQ ID NO: 26124

SEQ ID NO: 107151 - DNA, 201 bp, Bos taurus; identical to SEQ ID NO: 26125

SEQ ID NO: 107152 - DNA, 201 bp, Bos taurus
caccaggcctagtctgggaggtgaccctcgcttagcctcctctgtccctctctttgctagtctgagggcagcctcctccaccccaaaccttcccctttcctgaagacaacaaggaggcctgagtgcccgctgttgggggagcagaaagtcacgctcctgctttgtcccctggctctttgctttgcatccctcaaaacccca

SEQ ID NO: 107153 - DNA, 201 bp, Bos taurus; identical to SEQ ID NO: 26126

SEQ ID NO: 107154 - DNA, 201 bp, Bos taurus; identical to SEQ ID NO: 26127

SEQ ID NO: 107155 - DNA, 201 bp, Bos taurus
catttccatagtaaccaaagtcaggccagtgccctcactaagagtagctcccgcgtgtgaattagtaagcttaaattccaaagttgaactggcacctccaaagagtgagataaaaaacactttgtatcaaagctgtgattaaaaaaatgtaaaagttaaacccacaggcatagagaaaaacgggcaatcctgaaaactgcc

SEQ ID NO: 107156 - DNA, 201 bp, Bos taurus
tttgaactgcaccttggaccaatggaaggccccctgcattgccacgcagcctttttcagacatggttcctcatctggaccactggatatggaaaatgaccaagtggccactgttttcttaattctcccaaggatggtgggtctagttccattctaggtgcttaggagatcgtggcatgtaacgggtgctgtcctagctcaa

SEQ ID NO: 107157 - DNA, 201 bp, Bos taurus
tagctttgactagacggaactttgtcggccaagtaatgtctgctgcttgtccccaactccttcctctccaacttccactccagatgctccttgggaaagctcagcaaagatcctagaactcacattagcactagaagtaaacctggagacattcccgccaagcctgttacctgacagggacatggaggtcctgagaagtaa

SEQ ID NO: 107158 - DNA, 201 bp, Bos taurus; identical to SEQ ID NO: 26128

SEQ ID NO: 107159 - DNA, 201 bp, Bos taurus
caggcatcagctgggtggggatgaaggtgatgcgcatgcgggataaaagcaataggaagttctatgggagaccacaaaagaatcaagccaggggcttgtgcacctggaaataattccgaatgtagagcacactatggagcagggctaaccggatacagttagaaaggttaaactgcaagaggctgggatggaagagtagca

SEQ ID NO: 107160 - DNA, 201 bp, Bos taurus
tactacaatccccttaggccatcctggaaggcagttgatgcagcatcaggcaacagcacaaaggtctgtgctacagcaacatgcaaagacttatccagcattgatatccagaacggcccagccgaagctttccacagctctagtaaaggttagagagatcgacagctggctccccgagtgaacagactggaagctcccact

SEQ ID NO: 107161 - DNA, 201 bp, Bos taurus
ccaagaggactgagcagatggtgggaaggtcctgctgggcagcaaggtggagggcggtctggcggtgcttggttaattcattcactttggcacctgcaaggagctgatgacgttgattacatgagcagctgctctaccaccaccaaccaaggtctggcataagggggcaagcctgccaatctcctgcccgccagggtttgc

SEQ ID NO: 107162 - DNA, 201 bp, Bos taurus
tatttaaccaatcccttcataatctggcctgtcacatacttttccaacctcagatcctgctattccttccactgagaattgtgacctcttcccaactcacatccaaaagaggcctattttccaaagcccagcccagagaagcccagtttatctcctgcagtacaggcttcccgacaccccaaacactccccacaccccaaa

SEQ ID NO: 107163 - DNA, 201 bp, Bos taurus; identical to SEQ ID NO: 26129

SEQ ID NO: 107164 - DNA, 201 bp, Bos taurus; identical to SEQ ID NO: 26130

SEQ ID NO: 107165 - DNA, 201 bp, Bos taurus; identical to SEQ ID NO: 26131

SEQ ID NO: 107166 - DNA, 201 bp, Bos taurus; identical to SEQ ID NO: 26132

SEQ ID NO: 107167 - DNA, 201 bp, Bos taurus
actgcttgtgggaatataattttgcacaaccattttagaaaagagtggcaacatctatcaaaggtgaaaagatacataccctgtaaccagcaatccggtcctggacatcagaccaacagaatatacatctatgtctgtaatgtataagagtggggacttttctggtggttctgtggtggttccaatgaaaagggtttgatc

SEQ ID NO: 107168 - DNA, 201 bp, Bos taurus; identical to SEQ ID NO: 26133

SEQ ID NO: 107169 - DNA, 201 bp, Bos taurus; identical to SEQ ID NO: 26134

SEQ ID NO: 107170 - DNA, 201 bp, Bos taurus; identical to SEQ ID NO: 26135

SEQ ID NO: 107171 - DNA, 201 bp, Bos taurus; identical to SEQ ID NO: 26136

SEQ ID NO: 107172 - DNA, 201 bp, Bos taurus
ctatccctcattgatctgcctaatatctttttggtacacttccaagtaagttgcaggctcgactatactttattcccagacatttcaccatgtatattattaaggagagttctgtattttattgttcctttgaggtaaaattttaaaacaatgaaatgagtaaataagtgtatacagccacttttgaaaaacttaatggca

SEQ ID NO: 107173 - DNA, 201 bp, Bos taurus
cctactctacttgagccttagttttggatttctgagccacaaagcctgggattggaaaagactcccatgcatagataatggctgtgggaaaagacaagccgtgctgtccctttgattgtggccagtgtgtcacctgttgactgtttgccctaaaaccctgcttagcccctgtctgcattatctcaggtgggtgacccttct

SEQ ID NO: 107174 - DNA, 201 bp, Bos taurus
gatggatgcctacaccctaggggagaaggagcagtgttcttggctgaggggtccatgcgctgagcctttttgttctcccctgtcaggtggccttggggcatcacaaagaaaactatttctctgaccctggacctcaagctgtgctgaagcaattccaggaggagttggctgccctggacaaggagattgaggtccgaaatg

SEQ ID NO: 107175 - DNA, 201 bp, Bos taurus
cactgccgaggaccctgggttcaatccctggtagggaactaaaattccacaagccatgtagtgaggcaaaaaaaaaaaaaaagtctatataagggtaactagagagtttttcaagaatatttgaattctaaactcggttagtgggtgtaatcataagacagtgggaaaggaatgtgaatgtcattaagacaagatagaatc

SEQ ID NO: 107176 - DNA, 201 bp, Bos taurus; identical to SEQ ID NO: 26137

SEQ ID NO: 107177 - DNA, 201 bp, Bos taurus
cggtaacccttcccccgactccactttccctgttggtactcctgcacacagacagatgcttccttcagaatcctatacagtgtggaaaacgcccacacacactcctcagtgtggagtccccctgcctctgccataccccccagtagctctggatttctcccctacagcttctccctctcaggctgtggcccctctaacttg

SEQ ID NO: 107178 - DNA, 201 bp, Bos taurus; identical to SEQ ID NO: 26138

SEQ ID NO: 107179 - DNA, 201 bp, Bos taurus; identical to SEQ ID NO: 26139

SEQ ID NO: 107180 - DNA, 201 bp, Bos taurus
gagagcagccgtatcacaggtgtgccagctcacctgcagaaactgaactttcaagaacgcgagttcaaacatttcttcgggccgcacgcctgtcatcaccaaggatgaaaaactgagcggtgctcagagctatctgagggctgttggggcaacaaggccgcccttgactgagggcttccagggctgagcctggggccttcg

SEQ ID NO: 107181 - DNA, 201 bp, Bos taurus; identical to SEQ ID NO: 26140

SEQ ID NO: 107182 - DNA, 201 bp, Bos taurus; identical to SEQ ID NO: 26141

SEQ ID NO: 107183 - DNA, 201 bp, Bos taurus; identical to SEQ ID NO: 26142

SEQ ID NO: 107184 - DNA, 201 bp, Bos taurus; identical to SEQ ID NO: 26147

SEQ ID NO: 107185 - DNA, 201 bp, Bos taurus; identical to SEQ ID NO: 26148

SEQ ID NO: 107186 - DNA, 201 bp, Bos taurus; identical to SEQ ID NO: 26149

SEQ ID NO: 107187 - DNA, 201 bp, Bos taurus; identical to SEQ ID NO: 26150

SEQ ID NO: 107188 - DNA, 201 bp, Bos taurus; identical to SEQ ID NO: 26151

SEQ ID NO: 107189 - DNA, 201 bp, Bos taurus; identical to SEQ ID NO: 26153

SEQ ID NO: 107190 - DNA, 201 bp, Bos taurus; identical to SEQ ID NO: 26155

SEQ ID NO: 107191 - DNA, 201 bp, Bos taurus; identical to SEQ ID NO: 26156

SEQ ID NO: 107192 - DNA, 201 bp, Bos taurus; identical to SEQ ID NO: 26157

SEQ ID NO: 107193 - DNA, 201 bp, Bos taurus; identical to SEQ ID NO: 26158

SEQ ID NO: 107194 - DNA, 201 bp, Bos taurus; identical to SEQ ID NO: 26159

SEQ ID NO: 107195 - DNA, 201 bp, Bos taurus; identical to SEQ ID NO: 26160

SEQ ID NO: 107196 - DNA, 201 bp, Bos taurus; identical to SEQ ID NO: 26161

SEQ ID NO: 107197 - DNA, 201 bp, Bos taurus; identical to SEQ ID NO: 26162

SEQ ID NO: 107198 - DNA, 201 bp, Bos taurus; identical to SEQ ID NO: 26164

SEQ ID NO: 107199 - DNA, 201 bp, Bos taurus; identical to SEQ ID NO: 26165

SEQ ID NO: 107200 - DNA, 201 bp, Bos taurus; identical to SEQ ID NO: 26166

SEQ ID NO: 107201 - DNA, 201 bp, Bos taurus; identical to SEQ ID NO: 26167

SEQ ID NO: 107202 - DNA, 201 bp, Bos taurus; identical to SEQ ID NO: 26168

SEQ ID NO: 107203 - DNA, 201 bp, Bos taurus; identical to SEQ ID NO: 26169

SEQ ID NO: 107204 - DNA, 201 bp, Bos taurus; identical to SEQ ID NO: 26170

SEQ ID NO: 107205 - DNA, 201 bp, Bos taurus; identical to SEQ ID NO: 26171

SEQ ID NO: 107206 - DNA, 201 bp, Bos taurus; identical to SEQ ID NO: 26176

SEQ ID NO: 107207 - DNA, 201 bp, Bos taurus; identical to SEQ ID NO: 26178

SEQ ID NO: 107208 - DNA, 201 bp, Bos taurus; identical to SEQ ID NO: 26179

SEQ ID NO: 107209 - DNA, 201 bp, Bos taurus; identical to SEQ ID NO: 26180

SEQ ID NO: 107210 - DNA, 201 bp, Bos taurus; identical to SEQ ID NO: 26183

SEQ ID NO: 107211 - DNA, 201 bp, Bos taurus; identical to SEQ ID NO: 26187

SEQ ID NO: 107212 - DNA, 201 bp, Bos taurus; identical to SEQ ID NO: 26189

SEQ ID NO: 107213 - DNA, 201 bp, Bos taurus; identical to SEQ ID NO: 26190

SEQ ID NO: 107214 - DNA, 201 bp, Bos taurus; identical to SEQ ID NO: 26191

SEQ ID NO: 107215 - DNA, 201 bp, Bos taurus; identical to SEQ ID NO: 26192

SEQ ID NO: 107216 - DNA, 201 bp, Bos taurus; identical to SEQ ID NO: 26195

SEQ ID NO: 107217 - DNA, 201 bp, Bos taurus; identical to SEQ ID NO: 26196

SEQ ID NO: 107218 - DNA, 201 bp, Bos taurus; identical to SEQ ID NO: 26197

SEQ ID NO: 107219 - DNA, 201 bp, Bos taurus; identical to SEQ ID NO: 26198

SEQ ID NO: 107220 - DNA, 201 bp, Bos taurus; identical to SEQ ID NO: 26199

SEQ ID NO: 107221 - DNA, 201 bp, Bos taurus; identical to SEQ ID NO: 26201

SEQ ID NO: 107222 - DNA, 201 bp, Bos taurus; identical to SEQ ID NO: 26203

SEQ ID NO: 107223 - DNA, 201 bp, Bos taurus; identical to SEQ ID NO: 26205

SEQ ID NO: 107224 - DNA, 201 bp, Bos taurus; identical to SEQ ID NO: 26208

SEQ ID NO: 107225 - DNA, 201 bp, Bos taurus; identical to SEQ ID NO: 26209

SEQ ID NO: 107226 - DNA, 201 bp, Bos taurus; identical to SEQ ID NO: 26210

SEQ ID NO: 107227 - DNA, 201 bp, Bos taurus; identical to SEQ ID NO: 26213

SEQ ID NO: 107228 - DNA, 201 bp, Bos taurus; identical to SEQ ID NO: 26214

SEQ ID NO: 107229 - DNA, 201 bp, Bos taurus; identical to SEQ ID NO: 26216

SEQ ID NO: 107230 - DNA, 201 bp, Bos taurus; identical to SEQ ID NO: 26217

SEQ ID NO: 107231 - DNA, 201 bp, Bos taurus; identical to SEQ ID NO: 26221

SEQ ID NO: 107232 - DNA, 201 bp, Bos taurus; identical to SEQ ID NO: 26229

SEQ ID NO: 107233 - DNA, 201 bp, Bos taurus; identical to SEQ ID NO: 26230

SEQ ID NO: 107234 - DNA, 201 bp, Bos taurus; identical to SEQ ID NO: 26231

SEQ ID NO: 107235 - DNA, 201 bp, Bos taurus; identical to SEQ ID NO: 26232

SEQ ID NO: 107236 - DNA, 201 bp, Bos taurus; identical to SEQ ID NO: 26233

SEQ ID NO: 107237 - DNA, 201 bp, Bos taurus; identical to SEQ ID NO: 26235

SEQ ID NO: 107238 - DNA, 201 bp, Bos taurus; identical to SEQ ID NO: 26236

SEQ ID NO: 107239 - DNA, 201 bp, Bos taurus; identical to SEQ ID NO: 26237

SEQ ID NO: 107240 - DNA, 201 bp, Bos taurus; identical to SEQ ID NO: 26239

SEQ ID NO: 107241 - DNA, 201 bp, Bos taurus; identical to SEQ ID NO: 26240

SEQ ID NO: 107242 - DNA, 201 bp, Bos taurus; identical to SEQ ID NO: 26241

SEQ ID NO: 107243 - DNA, 201 bp, Bos taurus; identical to SEQ ID NO: 26242

SEQ ID NO: 107244 - DNA, 201 bp, Bos taurus; identical to SEQ ID NO: 26243

SEQ ID NO: 107245 - DNA, 201 bp, Bos taurus; identical to SEQ ID NO: 26246

SEQ ID NO: 107246 - DNA, 201 bp, Bos taurus; identical to SEQ ID NO: 26248

SEQ ID NO: 107247 - DNA, 201 bp, Bos taurus; identical to SEQ ID NO: 26249

SEQ ID NO: 107248 - DNA, 201 bp, Bos taurus; identical to SEQ ID NO: 26250

SEQ ID NO: 107249 - DNA, 201 bp, Bos taurus; identical to SEQ ID NO: 26251

SEQ ID NO: 107250 - DNA, 201 bp, Bos taurus; identical to SEQ ID NO: 26252

SEQ ID NO: 107251 - DNA, 201 bp, Bos taurus; identical to SEQ ID NO: 26253

SEQ ID NO: 107252 - DNA, 201 bp, Bos taurus; identical to SEQ ID NO: 26254

SEQ ID NO: 107253 - DNA, 201 bp, Bos taurus; identical to SEQ ID NO: 26255

SEQ ID NO: 107254 - DNA, 201 bp, Bos taurus; identical to SEQ ID NO: 26256

SEQ ID NO: 107255 - DNA, 201 bp, Bos taurus; identical to SEQ ID NO: 26257

SEQ ID NO: 107256 - DNA, 201 bp, Bos taurus; identical to SEQ ID NO: 26258

SEQ ID NO: 107257 - DNA, 201 bp, Bos taurus; identical to SEQ ID NO: 26259

SEQ ID NO: 107258 - DNA, 201 bp, Bos taurus; identical to SEQ ID NO: 26260

SEQ ID NO: 107259 - DNA, 201 bp, Bos taurus; identical to SEQ ID NO: 26261

SEQ ID NO: 107260 - DNA, 201 bp, Bos taurus; identical to SEQ ID NO: 26262

SEQ ID NO: 107261 - DNA, 201 bp, Bos taurus; identical to SEQ ID NO: 26269

SEQ ID NO: 107262 - DNA, 201 bp, Bos taurus; identical to SEQ ID NO: 26270

SEQ ID NO: 107263 - DNA, 201 bp, Bos taurus; identical to SEQ ID NO: 26273

SEQ ID NO: 107264 - DNA, 201 bp, Bos taurus; identical to SEQ ID NO: 26276

SEQ ID NO: 107265 - DNA, 201 bp, Bos taurus; identical to SEQ ID NO: 26277

SEQ ID NO: 107266 - DNA, 201 bp, Bos taurus
ctggtggccgaggtcagtccacggtcctgctgggactctgcccagcgacaaggttacttcctagcgggtaaacagctccctgcggggagcacctgagtgtgtcacagcatccagatggcccacccacatcttggaggattgtaactggataaccccccaggaactcagtgatgtactctagcatccaattttaggacgatc

SEQ ID NO: 107267 - DNA, 201 bp, Bos taurus
accactggactgccagggaagtccctatttctcctttttaagagtcactctccccaacttgaaatgccagcattcctcctcagtagggttggggccttgtcgggttttcctcactcccttttcctttcttcccccccaccttccctccctccctttttttctccatgaagtatttattgtccgctgtaaacatttaggagg

SEQ ID NO: 107268 - DNA, 201 bp, Bos taurus; identical to SEQ ID NO: 26278

SEQ ID NO: 107269 - DNA, 201 bp, Bos taurus; identical to SEQ ID NO: 26279

SEQ ID NO: 107270 - DNA, 201 bp, Bos taurus; identical to SEQ ID NO: 26280

SEQ ID NO: 107271 - DNA, 201 bp, Bos taurus; identical to SEQ ID NO: 26281

SEQ ID NO: 107272 - DNA, 201 bp, Bos taurus; identical to SEQ ID NO: 26282

SEQ ID NO: 107273 - DNA, 201 bp, Bos taurus; identical to SEQ ID NO: 26284

SEQ ID NO: 107274 - DNA, 201 bp, Bos taurus
tttcaagctttttatgttgcacattataacaacacataatttcaggtgtcgaaatgaaccttgatacagatggcaggccaagttgacagtttcataggacgtttgatacatgtgcaaggttaagagccaaagtccagaccagagttctgaaaatagacaggcttttatccatagcagatactttcagaggaatttgagatt

SEQ ID NO: 107275 - DNA, 201 bp, Bos taurus
cctttattcattctgcaagtacggactcttgttagctcagagaacatatgtgagaaagcatggcttctgtcctgagtagagtctagcaggaagactcacgtgcagacacgcacagtgcgtggtgtaccccgtgcggcggtggagctgcgtgccagatacagcagagcctaaaggaaagaaccgctggccccatctgggggc

SEQ ID NO: 107276 - DNA, 201 bp, Bos taurus
cctaccagatgccccagcttcccgtggccgtgccccagcctgggctccggctccagccggccaaagcccagatcgtgaggagcaaccagcccagctcggctgtgcattcaagcaccgtcatctccacgggggcgtatggccaagtggcccattcaatggccagtaaataccagtcttcccaaggagacataggagtgagtc

SEQ ID NO: 107277 - DNA, 201 bp, Bos taurus; identical to SEQ ID NO: 26285

SEQ ID NO: 107278 - DNA, 201 bp, Bos taurus; identical to SEQ ID NO: 26286

SEQ ID NO: 107279 - DNA, 201 bp, Bos taurus; identical to SEQ ID NO: 26287

SEQ ID NO: 107280 - DNA, 201 bp, Bos taurus; identical to SEQ ID NO: 26288

SEQ ID NO: 107281 - DNA, 201 bp, Bos taurus; identical to SEQ ID NO: 26289

SEQ ID NO: 107282 - DNA, 201 bp, Bos taurus; identical to SEQ ID NO: 26290

SEQ ID NO: 107283 - DNA, 201 bp, Bos taurus
ctaagggccttgccacttgctactcccttttgctcaacgcactgtcccacatcttcacacagctggctgcttcacatcattcagtttcagttgcaggtcatggcctcagaaacttccctgatcacccatgtaaagcacaccacccaaggcgtgatcaaacacaccatcctgtcctattttacaacactatcgctacccaga

SEQ ID NO: 107284 - DNA, 201 bp, Bos taurus
gttgctactttggttaaattagaagctcataagtcattaacactcagggttgaacaattatctttcagctcctggcttttgaaatctctccaaggaaagcgaaatcaagcaagtggcaacagattcgttgtgatttttgttttaaaaaaccattaaatcggagaatccggaggaatgtcctggctgcactgttttagatag

SEQ ID NO: 107285 - DNA, 201 bp, Bos taurus; identical to SEQ ID NO: 26291

SEQ ID NO: 107286 - DNA, 201 bp, Bos taurus
ggagatctgagagacacccaaggtggacactgaacccagtgatcaaaacactggcctggcttccatcctggaaccacaatccattagccctggccaccacgcctaactcttttttttcctttgctcttaagcattctcaaagaaagatgcctgcaaggtgcatgggccgtgccttctccagatccacagaaaagactgtcc

SEQ ID NO: 107287 - DNA, 201 bp, Bos taurus
atgcaggtcagcctggggggcctgccctgtggtgccaaacggagatagttgggctttaagactatgtttacattgtaatcaagccaaaacagtactgaacgcctgtgtcgaagggcccttcccagcttcatcatgtgtggattacctccttccagccacgggcaaggggctccatctacttcactctctttgcacctgctc

SEQ ID NO: 107288 - DNA, 201 bp, Bos taurus; identical to SEQ ID NO: 26295

SEQ ID NO: 107289 - DNA, 201 bp, Bos taurus; identical to SEQ ID NO: 26296

SEQ ID NO: 107290 - DNA, 201 bp, Bos taurus; identical to SEQ ID NO: 26297

SEQ ID NO: 107291 - DNA, 201 bp, Bos taurus; identical to SEQ ID NO: 26299

SEQ ID NO: 107292 - DNA, 201 bp, Bos taurus; identical to SEQ ID NO: 26300

SEQ ID NO: 107293 - DNA, 201 bp, Bos taurus; identical to SEQ ID NO: 26302

SEQ ID NO: 107294 - DNA, 201 bp, Bos taurus
taggagggtctggtggtctgggttggttttggttttggtctctttttgtattccatctgcaggtgacatttccaggcagctctgcctcccctgtttgtttttttttttaattggcagagccttttgaggaaatgcccaaatttcccttttcttggagtggaagaaagattgggcggaggtggcttgattatctggcttcag

SEQ ID NO: 107295 - DNA, 201 bp, Bos taurus; identical to SEQ ID NO: 26303

SEQ ID NO: 107296 - DNA, 201 bp, Bos taurus
aaaaaaaaagctaacaaatcagaagtcaaagccagcagtcatgcttggggagagttcatcagccctgtgatgggtcagaggccaaggccaaccagaatgacgaccctccaccccactggatcaaggtctcttaggttcccagaggagtcatagaccacgcccatcttggaattccctaggagcccgcacctcctacacaag

SEQ ID NO: 107297 - DNA, 201 bp, Bos taurus
ctggcctttttacaacacttcaaactccccagcacatgttgctgccttaggatctgtcctccacctcccaccccggagcttgtccaaaggtcacttcccttagaagtaagtgcccggccccccccaccctataacaggacttttttttttctttctattaagaactgtgatctaatcctatttattggtggattgctgtgt

SEQ ID NO: 107298 - DNA, 201 bp, Bos taurus; identical to SEQ ID NO: 26306

SEQ ID NO: 107299 - DNA, 201 bp, Bos taurus
accgatccatcacccagagccctgaatgagctccgcacaggcaatgcgagggcagggcagggctgggcaggaaggccccttggccggcagggccagctgcttcctccagctccatggctggaaaaataccagccaggctaactgcctccagtctgctaggagatgacaggagccctcgaaggccggtgggcccacctccct

SEQ ID NO: 107300 - DNA, 201 bp, Bos taurus; identical to SEQ ID NO: 26309

SEQ ID NO: 107301 - DNA, 201 bp, Bos taurus; identical to SEQ ID NO: 26310

SEQ ID NO: 107302 - DNA, 201 bp, Bos taurus; identical to SEQ ID NO: 26311

SEQ ID NO: 107303 - DNA, 201 bp, Bos taurus; identical to SEQ ID NO: 26312

SEQ ID NO: 107304 - DNA, 201 bp, Bos taurus; identical to SEQ ID NO: 26313

SEQ ID NO: 107305 - DNA, 201 bp, Bos taurus; identical to SEQ ID NO: 26314

SEQ ID NO: 107306 - DNA, 201 bp, Bos taurus; identical to SEQ ID NO: 26315

SEQ ID NO: 107307 - DNA, 201 bp, Bos taurus; identical to SEQ ID NO: 26316

SEQ ID NO: 107308 - DNA, 201 bp, Bos taurus; identical to SEQ ID NO: 26317

SEQ ID NO: 107309 - DNA, 201 bp, Bos taurus; identical to SEQ ID NO: 26318

SEQ ID NO: 107310 - DNA, 201 bp, Bos taurus; identical to SEQ ID NO: 26319

SEQ ID NO: 107311 - DNA, 201 bp, Bos taurus; identical to SEQ ID NO: 26320

SEQ ID NO: 107312 - DNA, 201 bp, Bos taurus; identical to SEQ ID NO: 26321

SEQ ID NO: 107313 - DNA, 201 bp, Bos taurus; identical to SEQ ID NO: 26322

SEQ ID NO: 107314 - DNA, 201 bp, Bos taurus; identical to SEQ ID NO: 26323

SEQ ID NO: 107315 - DNA, 201 bp, Bos taurus; identical to SEQ ID NO: 26324

SEQ ID NO: 107316 - DNA, 201 bp, Bos taurus; identical to SEQ ID NO: 26325

SEQ ID NO: 107317 - DNA, 201 bp, Bos taurus; identical to SEQ ID NO: 26326

SEQ ID NO: 107318 - DNA, 201 bp, Bos taurus; identical to SEQ ID NO: 26327

SEQ ID NO: 107319 - DNA, 201 bp, Bos taurus; identical to SEQ ID NO: 26328

SEQ ID NO: 107320 - DNA, 201 bp, Bos taurus; identical to SEQ ID NO: 26329

SEQ ID NO: 107321 - DNA, 201 bp, Bos taurus; identical to SEQ ID NO: 26330

SEQ ID NO: 107322 - DNA, 201 bp, Bos taurus; identical to SEQ ID NO: 26331

SEQ ID NO: 107323 - DNA, 201 bp, Bos taurus; identical to SEQ ID NO: 26332

SEQ ID NO: 107324 - DNA, 201 bp, Bos taurus; identical to SEQ ID NO: 26333

SEQ ID NO: 107325 - DNA, 201 bp, Bos taurus; identical to SEQ ID NO: 26334

SEQ ID NO: 107326 - DNA, 201 bp, Bos taurus; identical to SEQ ID NO: 26335

SEQ ID NO: 107327 - DNA, 201 bp, Bos taurus; identical to SEQ ID NO: 26336

SEQ ID NO: 107328 - DNA, 201 bp, Bos taurus; identical to SEQ ID NO: 26337

SEQ ID NO: 107329 - DNA, 201 bp, Bos taurus; identical to SEQ ID NO: 26338

SEQ ID NO: 107330 - DNA, 201 bp, Bos taurus; identical to SEQ ID NO: 26339

SEQ ID NO: 107331 - DNA, 201 bp, Bos taurus; identical to SEQ ID NO: 26340

SEQ ID NO: 107332 - DNA, 201 bp, Bos taurus; identical to SEQ ID NO: 26341

SEQ ID NO: 107333 - DNA, 201 bp, Bos taurus; identical to SEQ ID NO: 26342

SEQ ID NO: 107334 - DNA, 201 bp, Bos taurus; identical to SEQ ID NO: 26343

SEQ ID NO: 107335 - DNA, 201 bp, Bos taurus; identical to SEQ ID NO: 26344

SEQ ID NO: 107336 - DNA, 201 bp, Bos taurus; identical to SEQ ID NO: 26345

SEQ ID NO: 107337 - DNA, 201 bp, Bos taurus; identical to SEQ ID NO: 26346

SEQ ID NO: 107338 - DNA, 201 bp, Bos taurus; identical to SEQ ID NO: 26347

SEQ ID NO: 107339 - DNA, 201 bp, Bos taurus; identical to SEQ ID NO: 26348

SEQ ID NO: 107340 - DNA, 201 bp, Bos taurus; identical to SEQ ID NO: 26349

SEQ ID NO: 107341 - DNA, 201 bp, Bos taurus; identical to SEQ ID NO: 26350

SEQ ID NO: 107342 - DNA, 201 bp, Bos taurus; identical to SEQ ID NO: 26351

SEQ ID NO: 107343 - DNA, 201 bp, Bos taurus; identical to SEQ ID NO: 26352

SEQ ID NO: 107344 - DNA, 201 bp, Bos taurus; identical to SEQ ID NO: 26353

SEQ ID NO: 107345 - DNA, 201 bp, Bos taurus; identical to SEQ ID NO: 26354

SEQ ID NO: 107346 - DNA, 201 bp, Bos taurus; identical to SEQ ID NO: 26355

SEQ ID NO: 107347 - DNA, 201 bp, Bos taurus; identical to SEQ ID NO: 26356

SEQ ID NO: 107348 - DNA, 201 bp, Bos taurus
ttttaattaaaaaaccgctagttatttttatttaaaatgcaaaaaaaaaaaaagttctttcattacaaaagacaaagctggccacagatctagcctcccatgtttcccagcccaaacactggacgtgaactttgccaccgtgtccaggtcgtgctgccctccgtgcgtctcagaccagcattggcactgactgtcctgcac

SEQ ID NO: 107349 - DNA, 201 bp, Bos taurus; identical to SEQ ID NO: 26359

SEQ ID NO: 107350 - DNA, 201 bp, Bos taurus
gtgcccctcagcacctggaagcaaattagccacccaagccctgctgggcctgcccagctgtcctcttatgcccgtggcctctggatcgtccagtggagtcagttatctgagctctgtccccttctttcagtccatctgtccatccgctcagccatccctccttcagcaaacatgtatgaaggcccaaccctgggctccatt

SEQ ID NO: 107351 - DNA, 201 bp, Bos taurus
atgtcttacatcacaaaaacaagttttcataggactaattcttccacttaccaattccatcattctggaaatgatcattctgggtatgatggaggcttttcccctttacagaaaaacacaaatgtataataatttaaacatacctaatatgaaagaacaataaccattttcctagtcccatgcaaaagaaatgtacagaac

SEQ ID NO: 107352 - DNA, 201 bp, Bos taurus; identical to SEQ ID NO: 26361

SEQ ID NO: 107353 - DNA, 201 bp, Bos taurus; identical to SEQ ID NO: 26362

SEQ ID NO: 107354 - DNA, 201 bp, Bos taurus; identical to SEQ ID NO: 26363

SEQ ID NO: 107355 - DNA, 201 bp, Bos taurus; identical to SEQ ID NO: 26365

SEQ ID NO: 107356 - DNA, 201 bp, Bos taurus; identical to SEQ ID NO: 26366

SEQ ID NO: 107357 - DNA, 201 bp, Bos taurus; identical to SEQ ID NO: 26367

SEQ ID NO: 107358 - DNA, 201 bp, Bos taurus; identical to SEQ ID NO: 26369

SEQ ID NO: 107359 - DNA, 201 bp, Bos taurus
taacggcagggacacctggaacctatgcccggaagaggggaatccaccggcttgcatttagtcagcgcgtgggttgccttgagccatctgactgtgctccattgagggaaacttggaaaggaagctagggaaatgatgaccctccctgggtccttacagggagcccctttgatgagataaccctgcagggtccctcttcct

SEQ ID NO: 107360 - DNA, 201 bp, Bos taurus; identical to SEQ ID NO: 26371

SEQ ID NO: 107361 - DNA, 201 bp, Bos taurus; identical to SEQ ID NO: 26372

SEQ ID NO: 107362 - DNA, 201 bp, Bos taurus; identical to SEQ ID NO: 26373

SEQ ID NO: 107363 - DNA, 201 bp, Bos taurus
ctctccacccagaacgatcacacttgagaaggaaccataatggaggtggcctgggtgtcatttcccaccccagctcccctgtctcccaccaaccttctctctccacccagaatgtacatgaggccagctaatgaggatttcagccccagtctccagagtttctcctatagaagacagggaactggagtactatcagagtta

SEQ ID NO: 107364 - DNA, 201 bp, Bos taurus; identical to SEQ ID NO: 26376

SEQ ID NO: 107365 - DNA, 201 bp, Bos taurus; identical to SEQ ID NO: 26377

SEQ ID NO: 107366 - DNA, 201 bp, Bos taurus; identical to SEQ ID NO: 26378

SEQ ID NO: 107367 - DNA, 201 bp, Bos taurus; identical to SEQ ID NO: 26379

SEQ ID NO: 107368 - DNA, 201 bp, Bos taurus
aggtgccttcgtgtctcctggggtgtgacacagcagtgtctctcctttccctgtgtggcctcagtgggaccagtctctgggctcatgtcagggcccctgcccaacacaggaggcaggaagccccatggcaggattagcatgtgccggggagacacacagaggctctggggtgacgagcaaggcccccccgggccaatccca

SEQ ID NO: 107369 - DNA, 201 bp, Bos taurus; identical to SEQ ID NO: 26380

SEQ ID NO: 107370 - DNA, 201 bp, Bos taurus
agggcgcctgaggccagagaatggcctgcaactggcaggaagcccaagtcaaagatggctctgcgcactcagctgttcgagtcctagaaggtggcaaaaacaccagtggccatgcaggaatcccagtctctgccagggtggccaagagtggcaggaccgttgagagggatgtgcggttctggaaccctcacccagcgtcca

SEQ ID NO: 107371 - DNA, 201 bp, Bos taurus
atgaacctgcacaaacatatttgtctctttaactggcaggggggaaaccagaccccctccaaggtataagtagtattaggccccaggtatgcctgctcccacagagggtagaggagactggcaggctgcagtccctgaggtcgcaaagagctggacacaacttggcgacaacaacaaatgcctgctccagagtaaaggcca

SEQ ID NO: 107372 - DNA, 201 bp, Bos taurus; identical to SEQ ID NO: 26381

SEQ ID NO: 107373 - DNA, 201 bp, Bos taurus; identical to SEQ ID NO: 26382

SEQ ID NO: 107374 - DNA, 201 bp, Bos taurus; identical to SEQ ID NO: 26383

SEQ ID NO: 107375 - DNA, 201 bp, Bos taurus; identical to SEQ ID NO: 26384

SEQ ID NO: 107376 - DNA, 201 bp, Bos taurus; identical to SEQ ID NO: 26385

SEQ ID NO: 107377 - DNA, 201 bp, Bos taurus; identical to SEQ ID NO: 26388

SEQ ID NO: 107378 - DNA, 201 bp, Bos taurus
aggatctatgattcaaggcagagtgtcttcagggcctgtggactcctttgttctttatgttcccaagcatcccgtttccttccgtctcactgctttgacatgctaggcctatcagtcctgccttaggctgcttccctcatggtgcccaggtggctgccacagcccagtcatcacactcagttgcaacaattttttgacata

SEQ ID NO: 107379 - DNA, 201 bp, Bos taurus; identical to SEQ ID NO: 26389

SEQ ID NO: 107380 - DNA, 201 bp, Bos taurus; identical to SEQ ID NO: 26390

SEQ ID NO: 107381 - DNA, 201 bp, Bos taurus; identical to SEQ ID NO: 26392

SEQ ID NO: 107382 - DNA, 201 bp, Bos taurus; identical to SEQ ID NO: 26393

SEQ ID NO: 107383 - DNA, 201 bp, Bos taurus; identical to SEQ ID NO: 26399

SEQ ID NO: 107384 - DNA, 201 bp, Bos taurus
aaaattttatgtcaaaccacgtgttttaatcccaccaggccagaatggaaaggaaggggacaaggtcagtgttggagtttcatcaacaagcttagcccccttctctaccacccactcccccagctccatttcttcaatcaatctttattaagaacataggtttgagtccacaggaacaaattcttctggctctttaaggaa

SEQ ID NO: 107385 - DNA, 201 bp, Bos taurus; identical to SEQ ID NO: 26400

SEQ ID NO: 107386 - DNA, 201 bp, Bos taurus
agactttctcagagagtaataatagtctgctttgaaatgggcgtcccctatttcaaagtcagacagggcacaaggccgagggccgtggggagcctcctgccaatgctgggacttggaaaccaggcgagagagagcggatccgagaggatgggatttcactcgcccttgtaactatggatgaaatgtgggccagtgtatgga

SEQ ID NO: 107387 - DNA, 201 bp, Bos taurus
agatgcccccaggaaggggtttgaccctgggcaaggccgtccctcaacagctgagatgcattttgatgctgttaatatccctagcagttggggatggactacttgcgtactgaagtggggccatctggggaccccaccacagcagtcagcacagatattagtcccctttttaagaattaatgatttgcccaaggtcacaca

SEQ ID NO: 107388 - DNA, 201 bp, Bos taurus; identical to SEQ ID NO: 26405

SEQ ID NO: 107389 - DNA, 201 bp, Bos taurus; identical to SEQ ID NO: 26406

SEQ ID NO: 107390 - DNA, 201 bp, Bos taurus; identical to SEQ ID NO: 26407

SEQ ID NO: 107391 - DNA, 201 bp, Bos taurus
caactaaccatgtgattctttttccattttcattccatagcaccagtccctctatagcccacagaaagagattgggaagagagttgttggaaatctaaatttgggggcagagaggaatgggtatttgacagggagggtatttaaggaagggtatatttcctttccttaattcaaatggggagtagggaaactcccaaagga

SEQ ID NO: 107392 - DNA, 201 bp, Bos taurus
gcataatcccatcagacggaaataggaacaaagtctaaaacttggctgattaaatcacttttcctatcaacatttattgtgatccttcagggcctccttcgaagcattggggattcaaagatgaataaaaaaacatggataatgctaattttggtaggtagcgatagttgaacaaatggccaaaagaatgcctacataatg

SEQ ID NO: 107393 - DNA, 201 bp, Bos taurus
tgattacgtcagctgaaactacgcgtgacacacacttccgtttctgcctgagaactcatgcagttctccacaccctttactcatcagggacctcttacatttggcaactgcccactcacacactgggggaaatgcctatgaggacggaaagaaaggaaaacgcactacaatcctagaaaaaaaaatgcactgtccggctct

SEQ ID NO: 107394 - DNA, 201 bp, Bos taurus; identical to SEQ ID NO: 26408

SEQ ID NO: 107395 - DNA, 201 bp, Bos taurus; identical to SEQ ID NO: 26409

SEQ ID NO: 107396 - DNA, 201 bp, Bos taurus; identical to SEQ ID NO: 26412

SEQ ID NO: 107397 - DNA, 201 bp, Bos taurus; identical to SEQ ID NO: 26413

SEQ ID NO: 107398 - DNA, 201 bp, Bos taurus; identical to SEQ ID NO: 26414

SEQ ID NO: 107399 - DNA, 201 bp, Bos taurus
aaacaaaccatgcacacacttacctccattttctgatttttccgaaataccagacagtttccaaaaggctttcatctgttctgcattcctgtaagaacaactatcttcagctaatgtgtctagtatgatgccttccttgtacatggatgagcacttcagtaaatacattttaaatatttcactagaactagtgctaaattt

SEQ ID NO: 107400 - DNA, 201 bp, Bos taurus; identical to SEQ ID NO: 26419

SEQ ID NO: 107401 - DNA, 201 bp, Bos taurus; identical to SEQ ID NO: 26420

SEQ ID NO: 107402 - DNA, 201 bp, Bos taurus; identical to SEQ ID NO: 26421

SEQ ID NO: 107403 - DNA, 201 bp, Bos taurus; identical to SEQ ID NO: 26422

SEQ ID NO: 107404 - DNA, 201 bp, Bos taurus; identical to SEQ ID NO: 26423

SEQ ID NO: 107405 - DNA, 201 bp, Bos taurus; identical to SEQ ID NO: 26424

SEQ ID NO: 107406 - DNA, 201 bp, Bos taurus; identical to SEQ ID NO: 26425

SEQ ID NO: 107407 - DNA, 201 bp, Bos taurus; identical to SEQ ID NO: 26426

SEQ ID NO: 107408 - DNA, 201 bp, Bos taurus; identical to SEQ ID NO: 26427

SEQ ID NO: 107409 - DNA, 201 bp, Bos taurus; identical to SEQ ID NO: 26428

SEQ ID NO: 107410 - DNA, 201 bp, Bos taurus; identical to SEQ ID NO: 26429

SEQ ID NO: 107411 - DNA, 201 bp, Bos taurus; identical to SEQ ID NO: 26430

SEQ ID NO: 107412 - DNA, 201 bp, Bos taurus; identical to SEQ ID NO: 26431

SEQ ID NO: 107413 - DNA, 201 bp, Bos taurus; identical to SEQ ID NO: 26432

SEQ ID NO: 107414 - DNA, 201 bp, Bos taurus; identical to SEQ ID NO: 26433

SEQ ID NO: 107415 - DNA, 201 bp, Bos taurus; identical to SEQ ID NO: 26434

SEQ ID NO: 107416 - DNA, 201 bp, Bos taurus; identical to SEQ ID NO: 26435

SEQ ID NO: 107417 - DNA, 201 bp, Bos taurus; identical to SEQ ID NO: 26436

SEQ ID NO: 107418 - DNA, 201 bp, Bos taurus; identical to SEQ ID NO: 26437

SEQ ID NO: 107419 - DNA, 201 bp, Bos taurus; identical to SEQ ID NO: 26438

SEQ ID NO: 107420 - DNA, 201 bp, Bos taurus; identical to SEQ ID NO: 26439

SEQ ID NO: 107421 - DNA, 201 bp, Bos taurus; identical to SEQ ID NO: 26440

SEQ ID NO: 107422 - DNA, 201 bp, Bos taurus; identical to SEQ ID NO: 26441

SEQ ID NO: 107423 - DNA, 201 bp, Bos taurus; identical to SEQ ID NO: 26442

SEQ ID NO: 107424 - DNA, 201 bp, Bos taurus; identical to SEQ ID NO: 26443

SEQ ID NO: 107425 - DNA, 201 bp, Bos taurus; identical to SEQ ID NO: 26444

SEQ ID NO: 107426 - DNA, 201 bp, Bos taurus; identical to SEQ ID NO: 26445

SEQ ID NO: 107427 - DNA, 201 bp, Bos taurus; identical to SEQ ID NO: 26446

SEQ ID NO: 107428 - DNA, 201 bp, Bos taurus; identical to SEQ ID NO: 26447

SEQ ID NO: 107429 - DNA, 201 bp, Bos taurus; identical to SEQ ID NO: 26448

SEQ ID NO: 107430 - DNA, 201 bp, Bos taurus; identical to SEQ ID NO: 26449

SEQ ID NO: 107431 - DNA, 201 bp, Bos taurus; identical to SEQ ID NO: 26450

SEQ ID NO: 107432 - DNA, 201 bp, Bos taurus; identical to SEQ ID NO: 26451

SEQ ID NO: 107433 - DNA, 201 bp, Bos taurus; identical to SEQ ID NO: 26453

SEQ ID NO: 107434 - DNA, 201 bp, Bos taurus; identical to SEQ ID NO: 26454

SEQ ID NO: 107435 - DNA, 201 bp, Bos taurus; identical to SEQ ID NO: 26455

SEQ ID NO: 107436 - DNA, 201 bp, Bos taurus; identical to SEQ ID NO: 26456

SEQ ID NO: 107437 - DNA, 201 bp, Bos taurus; identical to SEQ ID NO: 26457

SEQ ID NO: 107438 - DNA, 201 bp, Bos taurus; identical to SEQ ID NO: 26458

SEQ ID NO: 107439 - DNA, 201 bp, Bos taurus; identical to SEQ ID NO: 26459

SEQ ID NO: 107440 - DNA, 201 bp, Bos taurus; identical to SEQ ID NO: 26460

SEQ ID NO: 107441 - DNA, 201 bp, Bos taurus; identical to SEQ ID NO: 26461

SEQ ID NO: 107442 - DNA, 201 bp, Bos taurus; identical to SEQ ID NO: 26462

SEQ ID NO: 107443 - DNA, 201 bp, Bos taurus; identical to SEQ ID NO: 26463

SEQ ID NO: 107444 - DNA, 201 bp, Bos taurus; identical to SEQ ID NO: 26464

SEQ ID NO: 107445 - DNA, 201 bp, Bos taurus; identical to SEQ ID NO: 26465

SEQ ID NO: 107446 - DNA, 201 bp, Bos taurus; identical to SEQ ID NO: 26466

SEQ ID NO: 107447 - DNA, 201 bp, Bos taurus; identical to SEQ ID NO: 26467

SEQ ID NO: 107448 - DNA, 201 bp, Bos taurus; identical to SEQ ID NO: 26468

SEQ ID NO: 107449 - DNA, 201 bp, Bos taurus; identical to SEQ ID NO: 26469

SEQ ID NO: 107450 - DNA, 201 bp, Bos taurus; identical to SEQ ID NO: 26470

SEQ ID NO: 107451 - DNA, 201 bp, Bos taurus; identical to SEQ ID NO: 26471

SEQ ID NO: 107452 - DNA, 201 bp, Bos taurus; identical to SEQ ID NO: 26472

SEQ ID NO: 107453 - DNA, 201 bp, Bos taurus; identical to SEQ ID NO: 26473

SEQ ID NO: 107454 - DNA, 201 bp, Bos taurus; identical to SEQ ID NO: 26474

SEQ ID NO: 107455 - DNA, 201 bp, Bos taurus; identical to SEQ ID NO: 26475

SEQ ID NO: 107456 - DNA, 201 bp, Bos taurus; identical to SEQ ID NO: 26476

SEQ ID NO: 107457 - DNA, 201 bp, Bos taurus; identical to SEQ ID NO: 26477

SEQ ID NO: 107458 - DNA, 201 bp, Bos taurus; identical to SEQ ID NO: 26478

SEQ ID NO: 107459 - DNA, 201 bp, Bos taurus; identical to SEQ ID NO: 26479

SEQ ID NO: 107460 - DNA, 201 bp, Bos taurus; identical to SEQ ID NO: 26480

SEQ ID NO: 107461 - DNA, 201 bp, Bos taurus; identical to SEQ ID NO: 26481

SEQ ID NO: 107462 - DNA, 201 bp, Bos taurus; identical to SEQ ID NO: 26482

SEQ ID NO: 107463 - DNA, 201 bp, Bos taurus; identical to SEQ ID NO: 26483

SEQ ID NO: 107464 - DNA, 201 bp, Bos taurus; identical to SEQ ID NO: 26484

SEQ ID NO: 107465 - DNA, 201 bp, Bos taurus; identical to SEQ ID NO: 26485

SEQ ID NO: 107466 - DNA, 201 bp, Bos taurus; identical to SEQ ID NO: 26486

SEQ ID NO: 107467 - DNA, 201 bp, Bos taurus; identical to SEQ ID NO: 26487

SEQ ID NO: 107468 - DNA, 201 bp, Bos taurus; identical to SEQ ID NO: 26488

SEQ ID NO: 107469 - DNA, 201 bp, Bos taurus; identical to SEQ ID NO: 26489

SEQ ID NO: 107470 - DNA, 201 bp, Bos taurus; identical to SEQ ID NO: 26490

SEQ ID NO: 107471 - DNA, 201 bp, Bos taurus; identical to SEQ ID NO: 26491

SEQ ID NO: 107472 - DNA, 201 bp, Bos taurus; identical to SEQ ID NO: 26492

SEQ ID NO: 107473 - DNA, 201 bp, Bos taurus; identical to SEQ ID NO: 26493

SEQ ID NO: 107474 - DNA, 201 bp, Bos taurus; identical to SEQ ID NO: 26494

SEQ ID NO: 107475 - DNA, 201 bp, Bos taurus; identical to SEQ ID NO: 26495

SEQ ID NO: 107476 - DNA, 201 bp, Bos taurus; identical to SEQ ID NO: 26496

SEQ ID NO: 107477 - DNA, 201 bp, Bos taurus; identical to SEQ ID NO: 26497

SEQ ID NO: 107478 - DNA, 201 bp, Bos taurus; identical to SEQ ID NO: 26498

SEQ ID NO: 107479 - DNA, 201 bp, Bos taurus; identical to SEQ ID NO: 26499

SEQ ID NO: 107480 - DNA, 201 bp, Bos taurus; identical to SEQ ID NO: 26500

SEQ ID NO: 107481 - DNA, 201 bp, Bos taurus; identical to SEQ ID NO: 26501

SEQ ID NO: 107482 - DNA, 201 bp, Bos taurus; identical to SEQ ID NO: 26502

SEQ ID NO: 107483 - DNA, 201 bp, Bos taurus; identical to SEQ ID NO: 26503

SEQ ID NO: 107484 - DNA, 201 bp, Bos taurus; identical to SEQ ID NO: 26505

SEQ ID NO: 107485 - DNA, 201 bp, Bos taurus; identical to SEQ ID NO: 26506

SEQ ID NO: 107486 - DNA, 201 bp, Bos taurus; identical to SEQ ID NO: 26508

SEQ ID NO: 107487 - DNA, 201 bp, Bos taurus; identical to SEQ ID NO: 26509

SEQ ID NO: 107488 - DNA, 201 bp, Bos taurus; identical to SEQ ID NO: 26510

SEQ ID NO: 107489 - DNA, 201 bp, Bos taurus; identical to SEQ ID NO: 26511

SEQ ID NO: 107490 - DNA, 201 bp, Bos taurus; identical to SEQ ID NO: 26512

SEQ ID NO: 107491 - DNA, 201 bp, Bos taurus; identical to SEQ ID NO: 26513

SEQ ID NO: 107492 - DNA, 201 bp, Bos taurus; identical to SEQ ID NO: 26514

SEQ ID NO: 107493 - DNA, 201 bp, Bos taurus; identical to SEQ ID NO: 26515

SEQ ID NO: 107494 - DNA, 201 bp, Bos taurus; identical to SEQ ID NO: 26516

SEQ ID NO: 107495 - DNA, 201 bp, Bos taurus; identical to SEQ ID NO: 26517

SEQ ID NO: 107496 - DNA, 201 bp, Bos taurus; identical to SEQ ID NO: 26518

SEQ ID NO: 107497 - DNA, 201 bp, Bos taurus; identical to SEQ ID NO: 26519

SEQ ID NO: 107498 - DNA, 201 bp, Bos taurus; identical to SEQ ID NO: 26521

SEQ ID NO: 107499 - DNA, 201 bp, Bos taurus; identical to SEQ ID NO: 26522

SEQ ID NO: 107500 - DNA, 201 bp, Bos taurus; identical to SEQ ID NO: 26523

SEQ ID NO: 107501 - DNA, 201 bp, Bos taurus; identical to SEQ ID NO: 26524

SEQ ID NO: 107502 - DNA, 201 bp, Bos taurus; identical to SEQ ID NO: 26525

SEQ ID NO: 107503 - DNA, 201 bp, Bos taurus; identical to SEQ ID NO: 26526

SEQ ID NO: 107504 - DNA, 201 bp, Bos taurus; identical to SEQ ID NO: 26527

SEQ ID NO: 107505 - DNA, 201 bp, Bos taurus; identical to SEQ ID NO: 26528

SEQ ID NO: 107506 - DNA, 201 bp, Bos taurus; identical to SEQ ID NO: 26529

SEQ ID NO: 107507 - DNA, 201 bp, Bos taurus; identical to SEQ ID NO: 26530

SEQ ID NO: 107508 - DNA, 201 bp, Bos taurus; identical to SEQ ID NO: 26531

SEQ ID NO: 107509 - DNA, 201 bp, Bos taurus; identical to SEQ ID NO: 26532

SEQ ID NO: 107510 - DNA, 201 bp, Bos taurus; identical to SEQ ID NO: 26533

SEQ ID NO: 107511 - DNA, 201 bp, Bos taurus; identical to SEQ ID NO: 26534

SEQ ID NO: 107512 - DNA, 201 bp, Bos taurus; identical to SEQ ID NO: 26535

SEQ ID NO: 107513 - DNA, 201 bp, Bos taurus; identical to SEQ ID NO: 26536

SEQ ID NO: 107514 - DNA, 201 bp, Bos taurus; identical to SEQ ID NO: 26537

SEQ ID NO: 107515 - DNA, 201 bp, Bos taurus; identical to SEQ ID NO: 26538

SEQ ID NO: 107516 - DNA, 201 bp, Bos taurus; identical to SEQ ID NO: 26539

SEQ ID NO: 107517 - DNA, 201 bp, Bos taurus; identical to SEQ ID NO: 26540

SEQ ID NO: 107518 - DNA, 201 bp, Bos taurus; identical to SEQ ID NO: 26541

SEQ ID NO: 107519 - DNA, 201 bp, Bos taurus; identical to SEQ ID NO: 26543

SEQ ID NO: 107520 - DNA, 201 bp, Bos taurus; identical to SEQ ID NO: 26544

SEQ ID NO: 107521 - DNA, 201 bp, Bos taurus; identical to SEQ ID NO: 26545

SEQ ID NO: 107522 - DNA, 201 bp, Bos taurus; identical to SEQ ID NO: 26546

SEQ ID NO: 107523 - DNA, 201 bp, Bos taurus; identical to SEQ ID NO: 26547

SEQ ID NO: 107524 - DNA, 201 bp, Bos taurus; identical to SEQ ID NO: 26548

SEQ ID NO: 107525 - DNA, 201 bp, Bos taurus; identical to SEQ ID NO: 26549

SEQ ID NO: 107526 - DNA, 201 bp, Bos taurus; identical to SEQ ID NO: 26550

SEQ ID NO: 107527 - DNA, 201 bp, Bos taurus; identical to SEQ ID NO: 26551

SEQ ID NO: 107528 - DNA, 201 bp, Bos taurus; identical to SEQ ID NO: 26552

SEQ ID NO: 107529 - DNA, 201 bp, Bos taurus; identical to SEQ ID NO: 26553

SEQ ID NO: 107530 - DNA, 201 bp, Bos taurus; identical to SEQ ID NO: 26554

SEQ ID NO: 107531 - DNA, 201 bp, Bos taurus; identical to SEQ ID NO: 26555

SEQ ID NO: 107532 - DNA, 201 bp, Bos taurus; identical to SEQ ID NO: 26556

SEQ ID NO: 107533 - DNA, 201 bp, Bos taurus; identical to SEQ ID NO: 26557

SEQ ID NO: 107534 - DNA, 201 bp, Bos taurus; identical to SEQ ID NO: 26558

SEQ ID NO: 107535 - DNA, 201 bp, Bos taurus; identical to SEQ ID NO: 26559

SEQ ID NO: 107536 - DNA, 201 bp, Bos taurus; identical to SEQ ID NO: 26560

SEQ ID NO: 107537 - DNA, 201 bp, Bos taurus; identical to SEQ ID NO: 26561

SEQ ID NO: 107538 - DNA, 201 bp, Bos taurus; identical to SEQ ID NO: 26562

SEQ ID NO: 107539 - DNA, 201 bp, Bos taurus; identical to SEQ ID NO: 26563

SEQ ID NO: 107540 - DNA, 201 bp, Bos taurus; identical to SEQ ID NO: 26564

SEQ ID NO: 107541 - DNA, 201 bp, Bos taurus; identical to SEQ ID NO: 26565

SEQ ID NO: 107542 - DNA, 201 bp, Bos taurus; identical to SEQ ID NO: 26566

SEQ ID NO: 107543 - DNA, 201 bp, Bos taurus; identical to SEQ ID NO: 26567

SEQ ID NO: 107544 - DNA, 201 bp, Bos taurus; identical to SEQ ID NO: 26568

SEQ ID NO: 107545 - DNA, 201 bp, Bos taurus; identical to SEQ ID NO: 26569

SEQ ID NO: 107546 - DNA, 201 bp, Bos taurus; identical to SEQ ID NO: 26570

SEQ ID NO: 107547 - DNA, 201 bp, Bos taurus; identical to SEQ ID NO: 26571

SEQ ID NO: 107548 - DNA, 201 bp, Bos taurus; identical to SEQ ID NO: 26572

SEQ ID NO: 107549 - DNA, 201 bp, Bos taurus; identical to SEQ ID NO: 26573

SEQ ID NO: 107550 - DNA, 201 bp, Bos taurus; identical to SEQ ID NO: 26574

SEQ ID NO: 107551 - DNA, 201 bp, Bos taurus; identical to SEQ ID NO: 26575

SEQ ID NO: 107552 - DNA, 201 bp, Bos taurus; identical to SEQ ID NO: 26576

SEQ ID NO: 107553 - DNA, 201 bp, Bos taurus; identical to SEQ ID NO: 26577

SEQ ID NO: 107554 - DNA, 201 bp, Bos taurus; identical to SEQ ID NO: 26578

SEQ ID NO: 107555 - DNA, 201 bp, Bos taurus; identical to SEQ ID NO: 26579

SEQ ID NO: 107556 - DNA, 201 bp, Bos taurus; identical to SEQ ID NO: 26580

SEQ ID NO: 107557 - DNA, 201 bp, Bos taurus; identical to SEQ ID NO: 26581

SEQ ID NO: 107558 - DNA, 201 bp, Bos taurus; identical to SEQ ID NO: 26582

SEQ ID NO: 107559 - DNA, 201 bp, Bos taurus; identical to SEQ ID NO: 26583

SEQ ID NO: 107560 - DNA, 201 bp, Bos taurus; identical to SEQ ID NO: 26584

SEQ ID NO: 107561 - DNA, 201 bp, Bos taurus; identical to SEQ ID NO: 26585

SEQ ID NO: 107562 - DNA, 201 bp, Bos taurus; identical to SEQ ID NO: 26586

SEQ ID NO: 107563 - DNA, 201 bp, Bos taurus; identical to SEQ ID NO: 26587

SEQ ID NO: 107564 - DNA, 201 bp, Bos taurus; identical to SEQ ID NO: 26588

SEQ ID NO: 107565 - DNA, 201 bp, Bos taurus; identical to SEQ ID NO: 26589

SEQ ID NO: 107566 - DNA, 201 bp, Bos taurus; identical to SEQ ID NO: 26590

SEQ ID NO: 107567 - DNA, 201 bp, Bos taurus; identical to SEQ ID NO: 26591

SEQ ID NO: 107568 - DNA, 201 bp, Bos taurus; identical to SEQ ID NO: 26592

SEQ ID NO: 107569 - DNA, 201 bp, Bos taurus; identical to SEQ ID NO: 26593

SEQ ID NO: 107570 - DNA, 201 bp, Bos taurus; identical to SEQ ID NO: 26594

SEQ ID NO: 107571 - DNA, 201 bp, Bos taurus; identical to SEQ ID NO: 26595

SEQ ID NO: 107572 - DNA, 201 bp, Bos taurus; identical to SEQ ID NO: 26596

SEQ ID NO: 107573 - DNA, 201 bp, Bos taurus; identical to SEQ ID NO: 26597

SEQ ID NO: 107574 - DNA, 201 bp, Bos taurus; identical to SEQ ID NO: 26598

SEQ ID NO: 107575 - DNA, 201 bp, Bos taurus; identical to SEQ ID NO: 26599

SEQ ID NO: 107576 - DNA, 201 bp, Bos taurus; identical to SEQ ID NO: 26600

SEQ ID NO: 107577 - DNA, 201 bp, Bos taurus; identical to SEQ ID NO: 26601

SEQ ID NO: 107578 - DNA, 201 bp, Bos taurus; identical to SEQ ID NO: 26602

SEQ ID NO: 107579 - DNA, 201 bp, Bos taurus; identical to SEQ ID NO: 26603

SEQ ID NO: 107580 - DNA, 201 bp, Bos taurus; identical to SEQ ID NO: 26604

SEQ ID NO: 107581 - DNA, 201 bp, Bos taurus; identical to SEQ ID NO: 26605

SEQ ID NO: 107582 - DNA, 201 bp, Bos taurus; identical to SEQ ID NO: 26606

SEQ ID NO: 107583 - DNA, 201 bp, Bos taurus; identical to SEQ ID NO: 26607

SEQ ID NO: 107584 - DNA, 201 bp, Bos taurus; identical to SEQ ID NO: 26608

SEQ ID NO: 107585 - DNA, 201 bp, Bos taurus; identical to SEQ ID NO: 26609

SEQ ID NO: 107586 - DNA, 201 bp, Bos taurus; identical to SEQ ID NO: 26610

SEQ ID NO: 107587 - DNA, 201 bp, Bos taurus; identical to SEQ ID NO: 26611

SEQ ID NO: 107588 - DNA, 201 bp, Bos taurus; identical to SEQ ID NO: 26612

SEQ ID NO: 107589 - DNA, 201 bp, Bos taurus; identical to SEQ ID NO: 26613

SEQ ID NO: 107590 - DNA, 201 bp, Bos taurus; identical to SEQ ID NO: 26614

SEQ ID NO: 107591 - DNA, 201 bp, Bos taurus; identical to SEQ ID NO: 26615

SEQ ID NO: 107592 - DNA, 201 bp, Bos taurus; identical to SEQ ID NO: 26616

SEQ ID NO: 107593 - DNA, 201 bp, Bos taurus; identical to SEQ ID NO: 26617

SEQ ID NO: 107594 - DNA, 201 bp, Bos taurus; identical to SEQ ID NO: 26618

SEQ ID NO: 107595 - DNA, 201 bp, Bos taurus; identical to SEQ ID NO: 26619

SEQ ID NO: 107596 - DNA, 201 bp, Bos taurus; identical to SEQ ID NO: 26621

SEQ ID NO: 107597 - DNA, 201 bp, Bos taurus; identical to SEQ ID NO: 26622

SEQ ID NO: 107598 - DNA, 201 bp, Bos taurus
tagcttttcctgaaaatttcctcaaaacagtaattcacccataatgtctctgactgctgtaatatcagaagtttctctttcacttctcctaaatcataaagtgatgtgcaccatttttattaactccagtgactaaaaatctttaagaggtgatggatgtgactattcccaaatgaagcagctaccagcattcagacctat

SEQ ID NO: 107599 - DNA, 201 bp, Bos taurus
tagtcaaaatgatgtattacatgggtactttaattgaggagcataaatatagagttctgggaatgggtttaatttgatcacataattttaaatgatgcacattaataattaacacattatgctcaaatataacttgagttatacaaattcccacagaaattaaatgaccataattagcattaccttaataaatatcaaata

SEQ ID NO: 107600 - DNA, 201 bp, Bos taurus; identical to SEQ ID NO: 26625

SEQ ID NO: 107601 - DNA, 201 bp, Bos taurus
ttctttaaatcactaggatgaatcaccagttggcattcattgcagttatataccagtgagagcagatggaatataaaatggtatgaaacatgtctactgaagaaacaagcattttaaaagttaatgaaagacaaaacaacgtaagtataaagtaggctgggtgaatgttaacatagcaactatagcataaagagaacccct

SEQ ID NO: 107602 - DNA, 201 bp, Bos taurus; identical to SEQ ID NO: 26626

SEQ ID NO: 107603 - DNA, 201 bp, Bos taurus
gaaacagagaaaccatgctttggttagaagcatggttagaagctttggttagaagcatatcagaagtgccttttccctgaaaggctgaaataatttgtacatgaatataattaaatgtatctctttgggctggagtctgaagaatagtactctgctgactgtccccaattcttccactgttaggatcagttgaggatttgg

SEQ ID NO: 107604 - DNA, 201 bp, Bos taurus; identical to SEQ ID NO: 26627

SEQ ID NO: 107605 - DNA, 201 bp, Bos taurus; identical to SEQ ID NO: 26628

SEQ ID NO: 107606 - DNA, 201 bp, Bos taurus; identical to SEQ ID NO: 26629

SEQ ID NO: 107607 - DNA, 201 bp, Bos taurus; identical to SEQ ID NO: 26631

SEQ ID NO: 107608 - DNA, 201 bp, Bos taurus
aaattaaatgcaaattattttattactttctgaagttcattgtacttataacaaaatctattgttccatagctaaaggattctgttctgccattattagttgagttcatatcaaaaggccttgtacaagatatttctggaggtaaaatatgttagatattattcctattatggaacaaccagacaagtaagcaggtatttc

SEQ ID NO: 107609 - DNA, 201 bp, Bos taurus
ctgagaatgacaaagggtggctgtcacccttgatggacagagtgtttgggtcctgcagcagccttggcagtaagactttttcaaaggctcttgttttggtggaagcaatatcagtgagtgtttttaagttttcctaccaggatagcataatatataatgtgggtacttgggtttttggaaagctgtgagggtgtggtaggt

SEQ ID NO: 107610 - DNA, 201 bp, Bos taurus
ttacaacccatattatgatctaaccgagtttgtttagaaaaatctataatcattttataaatgccaatggttttagtttatcctttgcataggtatgttaattaaagatatgcttgtttttttcgttttgttttattttcatcaatgtgaaaaatgaactctgatacaagtacaaaattagaataagacagattacaaggc

SEQ ID NO: 107611 - DNA, 201 bp, Bos taurus; identical to SEQ ID NO: 26634

SEQ ID NO: 107612 - DNA, 201 bp, Bos taurus
attttagaggcctcaggcaggagggttgctattttagactccccaaaaggcaaaagcgaggtcacagcacagaaagaattaaaggacaaactgtgtgatatctgcattttcacggctagcggtggcaaggtagatggcatgcagctatggcagtggaactaatcaaacatgtacatctgattaattttgatgtgttagagg

SEQ ID NO: 107613 - DNA, 201 bp, Bos taurus
acacatattttgatgaatcatgagaaagatgattgctaatattctgtcattttattcgtattattttcccagttttttcctgatcaaaactgaaagtaggcgcccttgagattttaagcaaccctcacattcctttttattaataaattcactccaggtagttaattttttaacttaagtttgttctctgtctctatgcag

SEQ ID NO: 107614 - DNA, 201 bp, Bos taurus
ctgaggtgactgttcaaaattgtatctggagttcatactaatctttttatcaaagagtggttcaaccatacccttcaacctactctcttcagtactaagctctctctctctctttttgcaatacggataggatgagaattttccaaatctttaagttgtggttacttttttgctaaataattctttttcaggccatctctc

SEQ ID NO: 107615 - DNA, 201 bp, Bos taurus
tcccattttgctgcattcctgatgtataaatgataaagcgacttagattcttagagaaaaaatgattccccataaacttgttgaagcaaatttctattcaacagttagcacatcaatagtgaaattgttggagtaggtcaaaagtgcatgactgcgtgctgacctacctgctaataataatcagaagccccttacacccct

SEQ ID NO: 107616 - DNA, 201 bp, Bos taurus
tcatatctagaatttcttttctgttttactgttttacttcatggaaacaatcagaagtcttaatatatagctgagaactatcttaaagagcacaaaatctcaacagactaaaattaagctgataatggtttatattactgagaatatactgagttgagtattataagcttctgataaaaatggtaaagttctattggaaag

SEQ ID NO: 107617 - DNA, 201 bp, Bos taurus; identical to SEQ ID NO: 26635

SEQ ID NO: 107618 - DNA, 201 bp, Bos taurus
atgatgtacctacatgtaggaagagtttactaggccaaagcaagaaatagtgtaaacgtccccagaggaacacttggcaaatgtgagggacaaaagaaaacgccagtgtggccagattgagtaaacattgtgactgagtgagaggataaagtccaggaaattgtcaggagcaagatattgcaggtcttgttggccatgatg

SEQ ID NO: 107619 - DNA, 201 bp, Bos taurus
ttgatcttggcagggcccagcctcctcccttgcttatccaaccattcttgtcttgggattttggtccacaggtgaaagatttccacttgctttgccctacaggaccaactgaggagggcccgacaacccactccaatattcttgtctggagaatcccatggacagaggagcctggagggctatatattccacagagttgca

SEQ ID NO: 107620 - DNA, 201 bp, Bos taurus
attgtcttttgacataaattatacttaagattgtagactaaaagtattatgctggaatgatttttatacagtcttatgtgatgctttatatgcaagtaaggtttgcccttgtgttcttggccatgattctgtctttcccgctgttaaaattgcaactgtcaaaccagcttctctcttaaacctagaggatgccatttttta

SEQ ID NO: 107621 - DNA, 201 bp, Bos taurus; identical to SEQ ID NO: 26636

SEQ ID NO: 107622 - DNA, 201 bp, Bos taurus
aaattttactgaatgctgtgggatatgctaaagtcccaacttcatgcaggattggagagagatgatgtattaattcataatgttactcaagtctctaatgcacattgtggagtttctgagtgttctatagaagttctgataggtttacaatataatactaagtagaacagttctcctcttttctctccccaactcctgctc

SEQ ID NO: 107623 - DNA, 201 bp, Bos taurus
ccatctaccttagcttaaatatatatatatatgttgatatatattaatgcacatatggattttgaaatgtgagattataacctttcaagctattatcatgttcagtacctatgcacttcgataagattaagctgtaagttttagctaattttcttgggatttaattttctgaaaaaattatgaattttcaaatgagtagaa

SEQ ID NO: 107624 - DNA, 201 bp, Bos taurus
atcaaggccctagtgattcacagaactggcaaatcagactcaggtctctctaatccttgattttgtgtttttaaatccctaggctatttaatagttccttctcaaactggccgtacttcatatactgttgctgttgttcagtcactcagtggtgtccaacactgcaagcccatgggctgcagcatgccaggcttccctgtt

SEQ ID NO: 107625 - DNA, 201 bp, Bos taurus; identical to SEQ ID NO: 26637

SEQ ID NO: 107626 - DNA, 201 bp, Bos taurus
caattatcaggtaagaacgtacaagggagcttaggtttcaatggaaatgaagagctttggagcagtaagacttgtaaggtgctacttcagatatttctaggcaaatcagagggctacttcagatattctccttcaattatctgggatgattttttctttatgaaagtctcagtgtccttaagtgaaaacctgtaaaacata

SEQ ID NO: 107627 - DNA, 201 bp, Bos taurus; identical to SEQ ID NO: 26638

SEQ ID NO: 107628 - DNA, 201 bp, Bos taurus; identical to SEQ ID NO: 26639

SEQ ID NO: 107629 - DNA, 201 bp, Bos taurus; identical to SEQ ID NO: 26640

SEQ ID NO: 107630 - DNA, 201 bp, Bos taurus; identical to SEQ ID NO: 26641

SEQ ID NO: 107631 - DNA, 201 bp, Bos taurus; identical to SEQ ID NO: 26644

SEQ ID NO: 107632 - DNA, 201 bp, Bos taurus
ggatgggtcaaggagcttcagagaagcaccaagatcttaaaccataatgggaagtgcatcttggctggttagtgtggaaccactagaggttccacactattgtctccccaacagagccattaaagcatgttgattaagcaaagcttaatgagacagcaatatgactgtaagggagaactctgctttgacagggtgttttag

SEQ ID NO: 107633 - DNA, 201 bp, Bos taurus; identical to SEQ ID NO: 26648

SEQ ID NO: 107634 - DNA, 201 bp, Bos taurus; identical to SEQ ID NO: 26649

SEQ ID NO: 107635 - DNA, 201 bp, Bos taurus
atcaatttaatgactttgtatgaatgcacttttaataaactagaaatgacaagtgaggttaaaacaacagtgcattgcacattatgaaattttgttttgagtatgtctgtgttgtacacctcattctgagcaagcaagtcagaagacctggttcagggggtctccaaaatcattttacaatcaggagcctacaataaccag

SEQ ID NO: 107636 - DNA, 201 bp, Bos taurus; identical to SEQ ID NO: 26651

SEQ ID NO: 107637 - DNA, 201 bp, Bos taurus
cttcctgatccagagatcgaacctgggtcctctgcactgcaagtgaactctttgccatctgagccacaaagaaaaatcaaattaagaaatgtaaactggttaggtttggccaaggactaaaataaatgctgtttgccttgctagttaaccagatgattaaactgtggtcatttttgcacccactagtttgaaaattcatga

SEQ ID NO: 107638 - DNA, 201 bp, Bos taurus; identical to SEQ ID NO: 26652

SEQ ID NO: 107639 - DNA, 201 bp, Bos taurus; identical to SEQ ID NO: 26654

SEQ ID NO: 107640 - DNA, 201 bp, Bos taurus; identical to SEQ ID NO: 26655

SEQ ID NO: 107641 - DNA, 201 bp, Bos taurus
gactgtaattatatcattttgagtttgggtttatgtcatttaaaataaaaagcaggacacaagtggaagcttactcttgtatctctcatgtccttctttgcacttgttagtctgagaaatagtctgtcatgatgtttttaaatacttctaactcacatgtgtagacaactataatgattttgagtgatggaggaactgatc

SEQ ID NO: 107642 - DNA, 201 bp, Bos taurus; identical to SEQ ID NO: 26659

SEQ ID NO: 107643 - DNA, 201 bp, Bos taurus; identical to SEQ ID NO: 26662

SEQ ID NO: 107644 - DNA, 201 bp, Bos taurus; identical to SEQ ID NO: 26663

SEQ ID NO: 107645 - DNA, 201 bp, Bos taurus; identical to SEQ ID NO: 26664

SEQ ID NO: 107646 - DNA, 201 bp, Bos taurus; identical to SEQ ID NO: 26665

SEQ ID NO: 107647 - DNA, 201 bp, Bos taurus
gcaggtaacttagcacctcccttccaggggtcttgccagcattaaattagttagcattaaattattaaattagtatgtgtaaactgcttggccagggcctaatgtatgataaacactatgtgaatgttagaggttttgtttgtttttgtctacacagcatgtgggatcttagctccctgatcagggattgaacccaggccc

SEQ ID NO: 107648 - DNA, 201 bp, Bos taurus
ctctggttaccgggatggcacagcccaggccttcagcccagggctgaagtccagagatgcagtggggctcagaggagaggctggagcctcagggatacattagaggcattataggggcccctgaccagcccaagtgtcacttgatacgaagcctctgaggattgcggcaaagaaaatgactaatgtgtgattaagtgataa

SEQ ID NO: 107649 - DNA, 201 bp, Bos taurus; identical to SEQ ID NO: 26667

SEQ ID NO: 107650 - DNA, 201 bp, Bos taurus
ggagtactgatatctaaaacttcagttatagcatttcctatttctcctttctgttacattagtttatttctttgtgcattttgaatttctctgattaggtgtatacacatttattattttaatgtcttcttgatgaccatgttttttattatagcatgtccctctttatctctaaaaacatttttgtcctgaagtataatt

SEQ ID NO: 107651 - DNA, 201 bp, Bos taurus
agctcttggtgcccatggaggttatggagaacagtttgtttgcttgtattgaatcttgtattgtccttcccttaggaggactcctgtgaggccttttgtgttgggctgagaccaatctgagagaaagactcagtgctgtgctcagaaccagcccttctacctgggccttttgtcctttcaccaaatctctgagccttcagt

SEQ ID NO: 107652 - DNA, 201 bp, Bos taurus; identical to SEQ ID NO: 26668

SEQ ID NO: 107653 - DNA, 201 bp, Bos taurus; identical to SEQ ID NO: 26669

SEQ ID NO: 107654 - DNA, 201 bp, Bos taurus; identical to SEQ ID NO: 26670

SEQ ID NO: 107655 - DNA, 201 bp, Bos taurus; identical to SEQ ID NO: 26671

SEQ ID NO: 107656 - DNA, 201 bp, Bos taurus; identical to SEQ ID NO: 26672

SEQ ID NO: 107657 - DNA, 201 bp, Bos taurus; identical to SEQ ID NO: 26673

SEQ ID NO: 107658 - DNA, 201 bp, Bos taurus
tttggaacaagtgtcctgtaccagtgttcagagtccacatcgccctggtaagggccttccttatcatatctgctcattgttctctgacaaagagaccaacagggccactgtttatagacactttttttctaggttttttatgtatttgcacatctgctttgctgtcagatgcctgcctcaaatcccactctggtgactgca

SEQ ID NO: 107659 - DNA, 201 bp, Bos taurus; identical to SEQ ID NO: 26674

SEQ ID NO: 107660 - DNA, 201 bp, Bos taurus; identical to SEQ ID NO: 26677

SEQ ID NO: 107661 - DNA, 201 bp, Bos taurus; identical to SEQ ID NO: 26678

SEQ ID NO: 107662 - DNA, 201 bp, Bos taurus; identical to SEQ ID NO: 26679

SEQ ID NO: 107663 - DNA, 201 bp, Bos taurus; identical to SEQ ID NO: 26681

SEQ ID NO: 107664 - DNA, 201 bp, Bos taurus
ggcggccaacaggcagatgaaaaaatgctcaacgctgctcactattggagaaacgcaatcaaaactacaatgaggcagcagcacctcataccagtcagcacggccgtcatcagaaagtctaccaacaaatgctggagaggctgtggagcaaagggagccctcccacactgctgatgggaatgctggtgcagccactgtgga

SEQ ID NO: 107665 - DNA, 201 bp, Bos taurus; identical to SEQ ID NO: 26682

SEQ ID NO: 107666 - DNA, 201 bp, Bos taurus
aaactctcacagctgtagtgctccctggagacccggccaccagactcagggaagtccaagtcacgcggagaggctcggggtcagtagcccagctgagccacggtcgcggtggcctgtgtgagtggacctcagaagacatccggcccagcgatgtcttctgggcaactcaactgtagaccccagctaacatggtatgaggct

SEQ ID NO: 107667 - DNA, 201 bp, Bos taurus; identical to SEQ ID NO: 26683

SEQ ID NO: 107668 - DNA, 201 bp, Bos taurus; identical to SEQ ID NO: 26684

SEQ ID NO: 107669 - DNA, 201 bp, Bos taurus; identical to SEQ ID NO: 26685

SEQ ID NO: 107670 - DNA, 201 bp, Bos taurus; identical to SEQ ID NO: 26686

SEQ ID NO: 107671 - DNA, 201 bp, Bos taurus; identical to SEQ ID NO: 26687

SEQ ID NO: 107672 - DNA, 201 bp, Bos taurus
atgtgtatgaagcactgacaattgttcttcagaagctgcattgtagattaggaattagaatctagggagtctgcggaggccatatgccaagaacttaagcacccaaactaggtttttgaatatgttaccagtagatgtggagttagcacttaaacttgaagagtggtaaaaaactgaatcatgggccacctggagcttccc

SEQ ID NO: 107673 - DNA, 201 bp, Bos taurus; identical to SEQ ID NO: 26689

SEQ ID NO: 107674 - DNA, 201 bp, Bos taurus; identical to SEQ ID NO: 26690

SEQ ID NO: 107675 - DNA, 201 bp, Bos taurus
tactgtacaaaacttttcatccatgaaggacaatcacagttcaactcatagcaaaagaaaaaacaaacaaataacaacaaaaaaagcattgatagcattggtactgcatcacataaagaaacctagctgcattttgaaagaagagttatagtgaccatttagagtgagagaaaccaacacataactctgagcaacatttat

SEQ ID NO: 107676 - DNA, 201 bp, Bos taurus
agccactgcattcttgaaacatttatatatgatatattccaaattagtcaatagcctgaaactttgaggtattttgatttttttgtgtcatgattagaaacaagaaataatacagtatgcacatatttccttgccctcaatacactacataacatctttcatgtaatttagttatggttccaaatttaattccatatacat

SEQ ID NO: 107677 - DNA, 201 bp, Bos taurus; identical to SEQ ID NO: 26691

SEQ ID NO: 107678 - DNA, 201 bp, Bos taurus; identical to SEQ ID NO: 26693

SEQ ID NO: 107679 - DNA, 201 bp, Bos taurus; identical to SEQ ID NO: 26695

SEQ ID NO: 107680 - DNA, 201 bp, Bos taurus; identical to SEQ ID NO: 26696

SEQ ID NO: 107681 - DNA, 201 bp, Bos taurus
ggcgaagagtcagacatgactgaagtgacttagtacgcatgcatgcaatgcttgtgcagagtagcatttgccagacagatgggaaatgggccagcttagcagtggaagaagcaacactgccaggcgtgagtaggaatcgcaaacagtacagcagggggaggagacaggggccactatctggggacttttctggagcaaaat

SEQ ID NO: 107682 - DNA, 201 bp, Bos taurus; identical to SEQ ID NO: 26698

SEQ ID NO: 107683 - DNA, 201 bp, Bos taurus
aaccccttggggaggctcacaggggtcaaaaggtagaccgtgaacagctgccgggtcattctagaagccagctctcctgacgtatctaaaggccctcttctctgagccccactttcttctactaaaaaatgatagggaccaccaagctccaaaatccatcccggcttcaagaccccctgataatgcttctcctaggtttct

SEQ ID NO: 107684 - DNA, 201 bp, Bos taurus
tcttccaaattaagacattcccatcctcaaagttcattcccctaattaatgtgtttgctgctaggaattaactgatcctttgtttctctctcagaaaaaatggtttcagcaaacctcatttcctgccaggacccctgcttcaggtgctttgaagccagaatgagtctaaagcagtgatgggaactgaaggaagcagacatt

SEQ ID NO: 107685 - DNA, 201 bp, Bos taurus; identical to SEQ ID NO: 26700

SEQ ID NO: 107686 - DNA, 201 bp, Bos taurus; identical to SEQ ID NO: 26701

SEQ ID NO: 107687 - DNA, 201 bp, Bos taurus
gacgaacagttgttctggccgtggcatctgttaactgcacttgggtaccattgctgctggcaatgtgtcggcatccacaattggcagaggaagagcctgctgggccgtagccgccacccatccgtcttcattcagcctccctcctaaaggccaaggttattgatgctctaacaagtgcactgacaggctttatcaaacttc

SEQ ID NO: 107688 - DNA, 201 bp, Bos taurus; identical to SEQ ID NO: 26704

SEQ ID NO: 107689 - DNA, 201 bp, Bos taurus; identical to SEQ ID NO: 26707

SEQ ID NO: 107690 - DNA, 201 bp, Bos taurus
cagtacatttcattgattcccaggcctccttgctcccatagccttcgtagcccgcggtcagtggtccccgtggggggaacccccgtgcgagcttgggggcaggtgcagatagaagttgggcctcaggcaagttgaccccagtgaccctgttgcttcttcccccaggaacggaggctggaccccctggacctcgtggtctcc

SEQ ID NO: 107691 - DNA, 201 bp, Bos taurus; identical to SEQ ID NO: 26710

SEQ ID NO: 107692 - DNA, 201 bp, Bos taurus; identical to SEQ ID NO: 26711

SEQ ID NO: 107693 - DNA, 201 bp, Bos taurus; identical to SEQ ID NO: 26712

SEQ ID NO: 107694 - DNA, 201 bp, Bos taurus; identical to SEQ ID NO: 26713

SEQ ID NO: 107695 - DNA, 201 bp, Bos taurus
gattttacttttggaagcagagacagaggccagcctctgaggaaggcagtgctgtccagatgagaaggtgtctcaccagtggagtccagtacctggcccaactggctgctggacccctctatgaaagtgttagtcactcactcgtgtctgactctttgccaccccatagactgtagcccaccaggatcctctgtccatggg

SEQ ID NO: 107696 - DNA, 201 bp, Bos taurus
gaccttggggccaggccaggagtggtctgcatcactgccatcctcaagcccttggcgggactcaggactgggctccaaccactggaaaggaaacagaaaccgtctcctgcgtggccaagaagaagaaaggaagcaggttttccttttcagcaagcatgctctctctgttaggggtcttaactcttctgtgtctgcgcacca

SEQ ID NO: 107697 - DNA, 201 bp, Bos taurus
aaagtcagaatgagggcttctacctacctacctcagttgcagggaaggtcctgcccccatgagcaaaaggtcaaggcttggaagcaggtgctaaaagttctgggcagaaagtctgcataggaccaaccgtgggccatgaaccatgagccagctcagagcgcagtgaccttggtgacatccccgtctcctgccccggggccg

SEQ ID NO: 107698 - DNA, 201 bp, Bos taurus
cggttgatataccagccctaaatgattttctcctttaccctcaatcagtcccttctaggatacctaccggactttttgggcctttgcccccacaaacttttggtcttttacttggccgatctagtttgatttctaaaggaattactgttcaccctggaataattgattcagactataaaggaacaattcaaattatgatgt

SEQ ID NO: 107699 - DNA, 201 bp, Bos taurus
gtgggattcccatgactattaatcacaccatagctcctcgcccagcaaagactcagcaggggctgcatcagctgtcctgtctgtctctgtctccagggcccatgctcaccctccttttatcctcgctgtcctgtcggtgtctcgtggctcatttgtgtgtcttgatccagtttaggcgtgtgaaagcagtcccgtctgtct

SEQ ID NO: 107700 - DNA, 201 bp, Bos taurus
aatcacgtcctgcaagggaggaaggttggggtgtcctgaggacctgtcctgcttgggagagaggtcacagttccatcaactctaaggccgattcggcaaatgcgtggtgtagtcaggtcccctgggaaacagagcctggggggagattttcactcagggaagtttggacccaaggcccaaggaaggaagcagggctggact

SEQ ID NO: 107701 - DNA, 201 bp, Bos taurus; identical to SEQ ID NO: 26715

SEQ ID NO: 107702 - DNA, 201 bp, Bos taurus
tggggtacaaattaattgcacggttcctcattttaaccccttgggacccagcccaaggtccttcctcaggcatttattgctgatatggaggagaaaggccagtgtgttgccatggaaaccattatgggaagaacagacaacacttctatctgagccagagaaaatgcatccaggcataaacactggtgggagttggaagtc

SEQ ID NO: 107703 - DNA, 201 bp, Bos taurus; identical to SEQ ID NO: 26716

SEQ ID NO: 107704 - DNA, 201 bp, Bos taurus; identical to SEQ ID NO: 26717

SEQ ID NO: 107705 - DNA, 201 bp, Bos taurus; identical to SEQ ID NO: 26718

SEQ ID NO: 107706 - DNA, 201 bp, Bos taurus; identical to SEQ ID NO: 26719

SEQ ID NO: 107707 - DNA, 201 bp, Bos taurus
tgtggcttatatcctttggtttgccacatttttcagattcaacagttttattttttctttcctttttctagatacattttggcaaactttgcttaacttttaaaaaaaatgatcagggttgagttttattaattcttggattttttgctttaatttttgctctgtattttcttttctttatgtttacatgtaaattgggtt

SEQ ID NO: 107708 - DNA, 201 bp, Bos taurus; identical to SEQ ID NO: 26720

SEQ ID NO: 107709 - DNA, 201 bp, Bos taurus
tgaaattcaaagacataaaatgtatttctggaatgaagacttttgagtgtatgcgtgaaaaccaaccccctgagcgtctgccctcagaatgacaacatctagccttcatttcaggagcctctgcttggggcaaacaggtctgttctgccgtcggcttgtattttcctcagcgacacaggaatgagcagtgggccactctga

SEQ ID NO: 107710 - DNA, 201 bp, Bos taurus; identical to SEQ ID NO: 26721

SEQ ID NO: 107711 - DNA, 201 bp, Bos taurus; identical to SEQ ID NO: 26722

SEQ ID NO: 107712 - DNA, 201 bp, Bos taurus; identical to SEQ ID NO: 26723

SEQ ID NO: 107713 - DNA, 201 bp, Bos taurus; identical to SEQ ID NO: 26724

SEQ ID NO: 107714 - DNA, 201 bp, Bos taurus; identical to SEQ ID NO: 26725

SEQ ID NO: 107715 - DNA, 201 bp, Bos taurus; identical to SEQ ID NO: 26726

SEQ ID NO: 107716 - DNA, 201 bp, Bos taurus; identical to SEQ ID NO: 26727

SEQ ID NO: 107717 - DNA, 201 bp, Bos taurus
actgcagaactcagggcctcctcctgcctgccccaccttgggtgttttccgtcccaggggaaacgtccatgcatccctgtttccatctgggagctcaggacgcagcccctcgggccctctggctttctgtatttccggtcccagatcacaggtagctgtttccagtacttacctcaccacgcctggactgaccagactatc

SEQ ID NO: 107718 - DNA, 201 bp, Bos taurus; identical to SEQ ID NO: 26730

SEQ ID NO: 107719 - DNA, 201 bp, Bos taurus
cccaagacgtcttcctccagaaggcccggctggctcacccacgccgtctctgccgggtggagttaagcctgccccctgagcccccagtgtctctgggctctgctgtgtctaccaagggactagggctgtcccgggaatgcttgttgcgtgaccgtctgtgggccctgcaggggttgctgagagactgctggccgggtaccc

SEQ ID NO: 107720 - DNA, 201 bp, Bos taurus; identical to SEQ ID NO: 26731

SEQ ID NO: 107721 - DNA, 201 bp, Bos taurus
gcccccacacgagccacacgagcgtctgcgaccacggcgaagtgagaaagggcaccaggggagtgcccagggtgctggccttccgccaaggcagaccacacgggcaagttcagggagatttctacagtgacaactttcccttctcaatgtccaagggctttgggtcgttgctttcctgaacttcagagcggcctggccaga

SEQ ID NO: 107722 - DNA, 201 bp, Bos taurus
aatgttcttttaaaataatggctctgcttgacaaagagcaaccatgtcaataccacgtggactgctgtgtaatcttttaaacgtgatgcactaggcgttccggagcttcttccgatggagactgtcgttcaaagtgtttgatagttgatggaggaacagaaggtcgagggagtgagttttagcgtctgcggatgtttcggt

SEQ ID NO: 107723 - DNA, 201 bp, Bos taurus; identical to SEQ ID NO: 26732

SEQ ID NO: 107724 - DNA, 201 bp, Bos taurus; identical to SEQ ID NO: 26733

SEQ ID NO: 107725 - DNA, 201 bp, Bos taurus
cccttgctcttctttcagcttgatcggcatcgtgtccgccgcagcagtttgcacttggagagagtagagtgctgctcatgcttgcctggccaggggcccttccagcagctccctgaggagatcagggggcttgcagacccctgactctgccaggaccccagcatgagcactgaccctccgcaagtacagaccagggagggc

SEQ ID NO: 107726 - DNA, 201 bp, Bos taurus
tttgaaggggctgagaagggacatcaggccaggcagccagcggtctctgtgccacggagctgaccgttcagtgatcatatggtggtcaagcagagcactgtgcaggccagggagctggccctgcacctgtaacgtgaggcagcagcattgatcaaagcacggggtggcttcacctgcaaaggaggagctgctggcaccccg

SEQ ID NO: 107727 - DNA, 201 bp, Bos taurus; identical to SEQ ID NO: 26737

SEQ ID NO: 107728 - DNA, 201 bp, Bos taurus; identical to SEQ ID NO: 26740

SEQ ID NO: 107729 - DNA, 201 bp, Bos taurus; identical to SEQ ID NO: 26741

SEQ ID NO: 107730 - DNA, 201 bp, Bos taurus; identical to SEQ ID NO: 26742

SEQ ID NO: 107731 - DNA, 201 bp, Bos taurus; identical to SEQ ID NO: 26743

SEQ ID NO: 107732 - DNA, 201 bp, Bos taurus; identical to SEQ ID NO: 26744

SEQ ID NO: 107733 - DNA, 201 bp, Bos taurus; identical to SEQ ID NO: 26745

SEQ ID NO: 107734 - DNA, 201 bp, Bos taurus; identical to SEQ ID NO: 26746

SEQ ID NO: 107735 - DNA, 201 bp, Bos taurus; identical to SEQ ID NO: 26747

SEQ ID NO: 107736 - DNA, 201 bp, Bos taurus; identical to SEQ ID NO: 26748

SEQ ID NO: 107737 - DNA, 201 bp, Bos taurus
tgatgaggctgtgggctggaaggaaccaaaagtgactgtgtttgttgtcaggttgctctcctttgcctcaagagaacggtcatgggtccctgggtgatgcatggtgtggactggtcgtgttcctgcagcatcctagttgcactaggagtagttggatgtgcttgtgaaacatgtcagatacagaaataaaagcatgaggat

SEQ ID NO: 107738 - DNA, 201 bp, Bos taurus
taagtgcaggccccctcccctgcacacacagtccagcctctctagccttccggctgtggttcagaccagcatgctgtgtgcagagcttacacgccctctgggggtacatccaaatcttcaagtggcccactcttccatacatttgcatcttgactttaataacacgtgtgtagtcaggtcaccagaaaattgggagaatcc

SEQ ID NO: 107739 - DNA, 201 bp, Bos taurus
cagcagggaccatgaaggcagagactggggatgcttctgcaggccagagagcaccagccagccagcaaccatgcggagccgggggcagggcctggaacacgttctccctaatagtccccggaaggaaccaaccctcctgacaccttattcttggacttccggcctctggaactatgagacaagagagataatacactactg

SEQ ID NO: 107740 - DNA, 201 bp, Bos taurus; identical to SEQ ID NO: 26750

SEQ ID NO: 107741 - DNA, 201 bp, Bos taurus
cacatatccagaaaaagtctgttaattcataaagatacaagtatacctatgttcacagcagcactattcacagtagccaagatatggaagcaacctaagcgttcacagacagataaagatgtggtatgtatgtgcaatggaatactactcggccatgaaaaagagtgaaataatgccatctgaagcaacatggagtgacct

SEQ ID NO: 107742 - DNA, 201 bp, Bos taurus; identical to SEQ ID NO: 26751

SEQ ID NO: 107743 - DNA, 201 bp, Bos taurus; identical to SEQ ID NO: 26753

SEQ ID NO: 107744 - DNA, 201 bp, Bos taurus; identical to SEQ ID NO: 26756

SEQ ID NO: 107745 - DNA, 201 bp, Bos taurus; identical to SEQ ID NO: 26757

SEQ ID NO: 107746 - DNA, 201 bp, Bos taurus; identical to SEQ ID NO: 26758

SEQ ID NO: 107747 - DNA, 201 bp, Bos taurus; identical to SEQ ID NO: 26762

SEQ ID NO: 107748 - DNA, 201 bp, Bos taurus; identical to SEQ ID NO: 26765

SEQ ID NO: 107749 - DNA, 201 bp, Bos taurus; identical to SEQ ID NO: 26766

SEQ ID NO: 107750 - DNA, 201 bp, Bos taurus; identical to SEQ ID NO: 26771

SEQ ID NO: 107751 - DNA, 201 bp, Bos taurus; identical to SEQ ID NO: 26777

SEQ ID NO: 107752 - DNA, 201 bp, Bos taurus; identical to SEQ ID NO: 26782

SEQ ID NO: 107753 - DNA, 201 bp, Bos taurus; identical to SEQ ID NO: 26783

SEQ ID NO: 107754 - DNA, 201 bp, Bos taurus; identical to SEQ ID NO: 26784

SEQ ID NO: 107755 - DNA, 201 bp, Bos taurus; identical to SEQ ID NO: 26785

SEQ ID NO: 107756 - DNA, 201 bp, Bos taurus; identical to SEQ ID NO: 26786

SEQ ID NO: 107757 - DNA, 201 bp, Bos taurus; identical to SEQ ID NO: 26787

SEQ ID NO: 107758 - DNA, 201 bp, Bos taurus; identical to SEQ ID NO: 66838

SEQ ID NO: 107759 - DNA, 201 bp, Bos taurus; identical to SEQ ID NO: 26790

SEQ ID NO: 107760 - DNA, 201 bp, Bos taurus; identical to SEQ ID NO: 26791

SEQ ID NO: 107761 - DNA, 201 bp, Bos taurus; identical to SEQ ID NO: 26792

SEQ ID NO: 107762 - DNA, 201 bp, Bos taurus; identical to SEQ ID NO: 26794

SEQ ID NO: 107763 - DNA, 201 bp, Bos taurus
taaactatgacttcagatccttgtttacttatttgatgcaatctacttacacttccatcaaagtgtgcctctaatgtataagttacatttctaacaacaaaaaaaaatgatccaaagctgtgctaattaaaacaaaataggataaataactttaagagataacagcagtatgattcagaagcatgcaaaaagtgtgcagac

SEQ ID NO: 107764 - DNA, 201 bp, Bos taurus; identical to SEQ ID NO: 26795

SEQ ID NO: 107765 - DNA, 201 bp, Bos taurus; identical to SEQ ID NO: 26796

SEQ ID NO: 107766 - DNA, 201 bp, Bos taurus; identical to SEQ ID NO: 26798

SEQ ID NO: 107767 - DNA, 201 bp, Bos taurus; identical to SEQ ID NO: 26799

SEQ ID NO: 107768 - DNA, 201 bp, Bos taurus; identical to SEQ ID NO: 26800

SEQ ID NO: 107769 - DNA, 201 bp, Bos taurus
tctggtggtaaccttaaataggagagtgtttatttatttatttatttacagcttccttgaacagagcagtttactaatttaaacaagtgtgaatcacatcgaactaaacatttggttttgtctcagaaattacacattttcacaaacttttcagtcatttctacccactatgaaacttttgcacctatctcatatttaaag

SEQ ID NO: 107770 - DNA, 201 bp, Bos taurus; identical to SEQ ID NO: 26801

SEQ ID NO: 107771 - DNA, 201 bp, Bos taurus; identical to SEQ ID NO: 26802

SEQ ID NO: 107772 - DNA, 201 bp, Bos taurus; identical to SEQ ID NO: 26803

SEQ ID NO: 107773 - DNA, 201 bp, Bos taurus
tacccatcctgggaagtcagggagatcccaaagctcagcaagatgggtcagaagccagtagccaaggtccctgaaaataaagcatgggagacagtcaccatgtgagccaataaaccttctggccaatatttctcaatcagagcaactgcttatccatagtgtctgaaggggctccctcaactatgacattctgaaagctaa

SEQ ID NO: 107774 - DNA, 201 bp, Bos taurus; identical to SEQ ID NO: 26806

SEQ ID NO: 107775 - DNA, 201 bp, Bos taurus
agggggctctctcctcctgcctcgtcttatctatcatgtctgaaacccgccctgtgtccacggaagtttggggttggccaaaaagtccgtttctggttttctgtatcattgttcagaaatacccgaatgaactttctggctgacccagggtgttggctgaatgctgcacccaagcccagtggttcttatgcagggcctgag

SEQ ID NO: 107776 - DNA, 201 bp, Bos taurus
caggctgcaggaggaaggggacatgggatccacccttccttcggcccaagccctctcacctgcagtccaggtgaagttgggcccagcaccccgcttccagggacaggaagctgaggactgactcatgagccacagggcttcctgaggctggcacagcagaggagccagttggccactctggtctcagtccctgagacccac

SEQ ID NO: 107777 - DNA, 201 bp, Bos taurus
accaaaacatcaggtgggtgaaaatgtctgtggatcttaaaaaggatggttgtaagcagcagataggtcacagagggtcaaggccccaaggcttacaggatgcaatcaagcatccagggcatgttgctacagtacaagctccctgggtactgactttggggaacagtgggtggcccctagaaggcattcagtggctattta

SEQ ID NO: 107778 - DNA, 201 bp, Bos taurus; identical to SEQ ID NO: 26809

SEQ ID NO: 107779 - DNA, 201 bp, Bos taurus; identical to SEQ ID NO: 26810

SEQ ID NO: 107780 - DNA, 201 bp, Bos taurus
tagagtatcactatattgcttttgttctcattgttgtggtaaccagggctcccctctttcctcttcatctctaattttagttgtcacggaatttgaggtttttctgtatcttaaagaaagacagcttcttgagtggaagaatcatagaacatgttatgggttcaggcctgacagagagagcttccacaaaaatttataaat

SEQ ID NO: 107781 - DNA, 201 bp, Bos taurus; identical to SEQ ID NO: 26811

SEQ ID NO: 107782 - DNA, 201 bp, Bos taurus
tgcgaagtgactggcacagagactctggcaagtgaacagagtcgtaatgcgtgctaatttctgggaaaaattcttttccttttcactcctggcttaggagataataactctgtaactaaagaccttgctagtctcctcacttgtcacacgattccttctcctcccccaataaaatggcatttaacccggcaaagttgtata

SEQ ID NO: 107783 - DNA, 201 bp, Bos taurus; identical to SEQ ID NO: 26813

SEQ ID NO: 107784 - DNA, 201 bp, Bos taurus; identical to SEQ ID NO: 26815

SEQ ID NO: 107785 - DNA, 201 bp, Bos taurus; identical to SEQ ID NO: 26816

SEQ ID NO: 107786 - DNA, 201 bp, Bos taurus; identical to SEQ ID NO: 26819

SEQ ID NO: 107787 - DNA, 201 bp, Bos taurus; identical to SEQ ID NO: 26820

SEQ ID NO: 107788 - DNA, 201 bp, Bos taurus; identical to SEQ ID NO: 26821

SEQ ID NO: 107789 - DNA, 201 bp, Bos taurus; identical to SEQ ID NO: 26825

SEQ ID NO: 107790 - DNA, 201 bp, Bos taurus; identical to SEQ ID NO: 26826

SEQ ID NO: 107791 - DNA, 201 bp, Bos taurus; identical to SEQ ID NO: 26827

SEQ ID NO: 107792 - DNA, 201 bp, Bos taurus; identical to SEQ ID NO: 26829

SEQ ID NO: 107793 - DNA, 201 bp, Bos taurus; identical to SEQ ID NO: 26830

SEQ ID NO: 107794 - DNA, 201 bp, Bos taurus; identical to SEQ ID NO: 26831

SEQ ID NO: 107795 - DNA, 201 bp, Bos taurus
ccccgccaggcacagaagccaccagcagtgccaggcagcgtccgcgggctgaacctggaggtgctgggtgcagcagaaagccagctcccagggactctgctggccccttgcccagcaaatgcgtggccatcgactgcgagatggtgggcacaggaccccgagggcgcgtgagtgagctggcccgctgctccgtggtgagct

SEQ ID NO: 107796 - DNA, 201 bp, Bos taurus
ttcctgactctcggccccttcctccacttccacagccagcggcagactgtcaagttctcaagtcagatctctctgaccttcacataaaaggaccttgggactgattatgctgggcccctctgaatcatcccaaaactctccctacctttatttttggttgctctgggtctttgttgctgcatgtgggctttctcttagtac

SEQ ID NO: 107797 - DNA, 201 bp, Bos taurus
gtgagttatgtccatctgccagatctgacttggcttcaggccacggggattaactcccaaggcttctgttggagatgtggttatcacaaccatctggcatgtaggataaggccatacaatctgtttagcttaagcccaagggatatgaaacttggtttttaaatattttaattacaatgtgacagatcatgaagggctgat

SEQ ID NO: 107798 - DNA, 201 bp, Bos taurus
gacgggctacaacccatagggtctcaaagagtcagacacgacttggcaagtgagtgcacacacactctgtcagaagttagggggctcctttctatggccacagcacctcacctgacccaccagcctctccctttcactgtctccctcctgcatggcaacgagtcaggacaatcagttatcttacatgtaacaaaagccctg

SEQ ID NO: 107799 - DNA, 201 bp, Bos taurus; identical to SEQ ID NO: 26834

SEQ ID NO: 107800 - DNA, 201 bp, Bos taurus; identical to SEQ ID NO: 26835

SEQ ID NO: 107801 - DNA, 201 bp, Bos taurus; identical to SEQ ID NO: 26836

SEQ ID NO: 107802 - DNA, 201 bp, Bos taurus
cttctgggagtggccacctttgcctagtgggaaggttctccttctaggaaagagtcagaaaagctctttacctttgtttgatttgttgtctctcggtctgtcccctggcctccaaagaaaggatcaccctgtgcacatgtgcacgtcctgagcacactctggaggaaataatagcttgcctatgggccagtggctcttagt

SEQ ID NO: 107803 - DNA, 201 bp, Bos taurus; identical to SEQ ID NO: 26837

SEQ ID NO: 107804 - DNA, 201 bp, Bos taurus; identical to SEQ ID NO: 26838

SEQ ID NO: 107805 - DNA, 201 bp, Bos taurus
tgctgattccatcgttctttcgttgttcattgactgtctcctctcgcaagaagccaaggccggggagaaagagcaggtggcccacagtttagggtcatgaaaagactgctgtgttgatggtaccctgtaagcatcagcagagtgagaaagggctctctctttcgaggtgtcctttagtctctgtgttttgccaatggcccg

SEQ ID NO: 107806 - DNA, 201 bp, Bos taurus; identical to SEQ ID NO: 26839

SEQ ID NO: 107807 - DNA, 201 bp, Bos taurus
aatcctaaccactaggcaatcagagaatccccagccctttatcttggtcaagctgagtactgagctatggaacaccttgccactccccacttaatcagaatagaaataaaacaaaccgatacatacacctctgtgcttcttgggtgtctttgttggactgccagattccaccttgaatttcatccaaccataacacagctg

SEQ ID NO: 107808 - DNA, 201 bp, Bos taurus; identical to SEQ ID NO: 26846

SEQ ID NO: 107809 - DNA, 201 bp, Bos taurus; identical to SEQ ID NO: 26847

SEQ ID NO: 107810 - DNA, 201 bp, Bos taurus
aaatgcctttactttgccaattttaatagtagttttccaatttgggtaatttaaacatgtattttctttctcctttctaaatcaatccagtcataaatctgtgttattctttttccttcaatttgtttatcaataacactagttcacttttctacttgtgaatatactacttttatccttattaattccttactcctggtt

SEQ ID NO: 107811 - DNA, 201 bp, Bos taurus
atttgacttctgtgtacctcgtataagtggaatcctataatatatgtcttttttgtgactggattatttctcttagcataatgtccttagagttcatccacgttgtagcatgtgttagagtttcttcctttttgaggctaaataatgttttattgtatgtatattttgtttcttcattcattcattaatgaaaacctagaa

SEQ ID NO: 107812 - DNA, 201 bp, Bos taurus
ttccccaggccactcctaccagctgactctgttccaggaagtttttgacgatccacagagggagacagcgctgaggactactcaccctgacctaccagtcatacaggccccttacagcccaaggaccccaaacaatgaatcagctgcatcagcttacatttaccattctgccccccaactgctgttcaatgccatcaggct

SEQ ID NO: 107813 - DNA, 201 bp, Bos taurus
cctggtaggccacagtccatgggattgtaagaatcggacaagacttaatgactgagcatgcacatcctaaattttgcatctggggtgtatgtctcacttccttcacccttgtcctggccctgtgagggagtaccagtttctggacttttctgtaagccactcctatgtggtggatgctcatccttgttcagttggcttcac

SEQ ID NO: 107814 - DNA, 201 bp, Bos taurus
agcaaggacgccaacaatagacacacaagtgtaatatcattctatgaacgaatacctgtaaagctgttagaacaccggaaatctagtaagcccacatgtttgatatcattaatgcagtgcaatgatcattaccttcatggaggtaagaaaaaagggtccagggaaagtcacccgctgattcagcccaagaaaagcaggagg

SEQ ID NO: 107815 - DNA, 201 bp, Bos taurus; identical to SEQ ID NO: 26849

SEQ ID NO: 107816 - DNA, 201 bp, Bos taurus; identical to SEQ ID NO: 26851

SEQ ID NO: 107817 - DNA, 201 bp, Bos taurus
agaaacagaaaacataggcccctgactttttgctcctctcttgaaactgagctagaatgcaattgatattcatatgaacaagtaagtttttgaggtttgaaatgcaataccagggaaacaggaccttgagaaaagggagggctcctatgctgctggagggaaaccacaccctaaaactaaggctaaaattcaaattggatt

SEQ ID NO: 107818 - DNA, 201 bp, Bos taurus; identical to SEQ ID NO: 26853

SEQ ID NO: 107819 - DNA, 201 bp, Bos taurus; identical to SEQ ID NO: 26854

SEQ ID NO: 107820 - DNA, 201 bp, Bos taurus; identical to SEQ ID NO: 26855

SEQ ID NO: 107821 - DNA, 201 bp, Bos taurus; identical to SEQ ID NO: 26856

SEQ ID NO: 107822 - DNA, 201 bp, Bos taurus; identical to SEQ ID NO: 26857

SEQ ID NO: 107823 - DNA, 201 bp, Bos taurus
actcattatcatggtcccatcaaggggcaatatttctaactagagctgatgcgtccaatccaggctgcttcaccattctcagaactcacattcactctgaactcctgccttcattagccactgcagggttctctcagctctgtttagggcagctctacctctctgggtctcactgttacatacctatattgagctgaggct

SEQ ID NO: 107824 - DNA, 201 bp, Bos taurus; identical to SEQ ID NO: 26858

SEQ ID NO: 107825 - DNA, 201 bp, Bos taurus; identical to SEQ ID NO: 26859

SEQ ID NO: 107826 - DNA, 201 bp, Bos taurus; identical to SEQ ID NO: 26864

SEQ ID NO: 107827 - DNA, 201 bp, Bos taurus; identical to SEQ ID NO: 26865

SEQ ID NO: 107828 - DNA, 201 bp, Bos taurus; identical to SEQ ID NO: 26866

SEQ ID NO: 107829 - DNA, 201 bp, Bos taurus; identical to SEQ ID NO: 26867

SEQ ID NO: 107830 - DNA, 201 bp, Bos taurus; identical to SEQ ID NO: 26868

SEQ ID NO: 107831 - DNA, 201 bp, Bos taurus
cctggggtgactggggcaggtggagagtaacctgaaggtaagacccccactcccaatgaaagacatgcttgtgggatggactctggattgtctggtttgcggaaggaagacatcctaggggcctcctgtaccatctccaagaactggccagcctgggagtgtgggggttcagtccctgcagggtcagcaaggcctgaagca

SEQ ID NO: 107832 - DNA, 201 bp, Bos taurus; identical to SEQ ID NO: 26869

SEQ ID NO: 107833 - DNA, 201 bp, Bos taurus; identical to SEQ ID NO: 26870

SEQ ID NO: 107834 - DNA, 201 bp, Bos taurus; identical to SEQ ID NO: 26871

SEQ ID NO: 107835 - DNA, 201 bp, Bos taurus
ctctagtcaattgctattgatgggggaacaccaagaaccctgttcaatatcaataccatatatatctattagatggccaaaatctggaagatggacccacaaaatactgtcaaggaagagaagaaacaggaactgtctttcattatcagtgggaatgcaaaatggtatggccactttggaaggcgatttctttcaaaacta

SEQ ID NO: 107836 - DNA, 201 bp, Bos taurus; identical to SEQ ID NO: 26872

SEQ ID NO: 107837 - DNA, 201 bp, Bos taurus; identical to SEQ ID NO: 26873

SEQ ID NO: 107838 - DNA, 201 bp, Bos taurus; identical to SEQ ID NO: 26876

SEQ ID NO: 107839 - DNA, 201 bp, Bos taurus; identical to SEQ ID NO: 26877

SEQ ID NO: 107840 - DNA, 201 bp, Bos taurus; identical to SEQ ID NO: 26878

SEQ ID NO: 107841 - DNA, 201 bp, Bos taurus; identical to SEQ ID NO: 26879

SEQ ID NO: 107842 - DNA, 201 bp, Bos taurus
tcagtattagatgataggaaagaattctttgactagtgtaaataaaggcgataaagttgctgtgatgaagaaactgtcttatattttataaatattgagcaatttagggggtgaaatgctgtgatgtcagacatttgccttcaaatacttcctactgatgggtgtgatgaaaaaacactgatgattattaaatctggatga

SEQ ID NO: 107843 - DNA, 201 bp, Bos taurus; identical to SEQ ID NO: 26881

SEQ ID NO: 107844 - DNA, 201 bp, Bos taurus; identical to SEQ ID NO: 26883

SEQ ID NO: 107845 - DNA, 201 bp, Bos taurus; identical to SEQ ID NO: 26885

SEQ ID NO: 107846 - DNA, 201 bp, Bos taurus; identical to SEQ ID NO: 26886

SEQ ID NO: 107847 - DNA, 201 bp, Bos taurus; identical to SEQ ID NO: 26888

SEQ ID NO: 107848 - DNA, 201 bp, Bos taurus; identical to SEQ ID NO: 26889

SEQ ID NO: 107849 - DNA, 201 bp, Bos taurus; identical to SEQ ID NO: 26890

SEQ ID NO: 107850 - DNA, 201 bp, Bos taurus; identical to SEQ ID NO: 26891

SEQ ID NO: 107851 - DNA, 201 bp, Bos taurus
cagggttgggaaagccagctgcttcaggatccatgtggggggctggaaaacagtctatcagagttggaaggaccgagaccttctggaggaaagagtggccctgaaggggttgcgctgggatgttggctgctgagaacctggggatgatgggcagtcagcctccggcaggtgaacttagagtgctgccctttctctgggtgg

SEQ ID NO: 107852 - DNA, 201 bp, Bos taurus
ggagacacaggctttgggaacctcctgtcctccctacagcacgcctgcatggtatgtgaggagcagaggttagggcagggccgcatgcctggaaagtgctggaaaagatcagggatcatcatcatcatcatcatttttattcccatgattcctaccatcccagggcaggttctatacaaactacctcggctatttttgaaa

SEQ ID NO: 107853 - DNA, 201 bp, Bos taurus
tggagggggtggcctgatgcctgcgcccctcctcccgctgctggcaggactcctggtacagcagatcctcttcttcctggggaccttgaccctggccttcctggtgttcatgcccatgcttcacggcaggaacctcctgctcctccattacctgaagtcctcgtggtgagtgaggaaggggctgagggttctgagacccct

SEQ ID NO: 107854 - DNA, 201 bp, Bos taurus; identical to SEQ ID NO: 26892

SEQ ID NO: 107855 - DNA, 201 bp, Bos taurus
ccccctgtcttgggcacaccctacattgtcttaccaggaaagtggacttcccctctcttgggtcccctacacagatctgcttttggccagtgtagaaatcgaagcgactgtgacactctccatccctctgaattgtcagctgcacctcctggagtgtgattgctctcctgtgcagtctggtgaggccccagccggccacgg

SEQ ID NO: 107856 - DNA, 201 bp, Bos taurus; identical to SEQ ID NO: 26894

SEQ ID NO: 107857 - DNA, 201 bp, Bos taurus; identical to SEQ ID NO: 26895

SEQ ID NO: 107858 - DNA, 201 bp, Bos taurus; identical to SEQ ID NO: 26897

SEQ ID NO: 107859 - DNA, 201 bp, Bos taurus; identical to SEQ ID NO: 26898

SEQ ID NO: 107860 - DNA, 201 bp, Bos taurus; identical to SEQ ID NO: 26899

SEQ ID NO: 107861 - DNA, 201 bp, Bos taurus; identical to SEQ ID NO: 26900

SEQ ID NO: 107862 - DNA, 201 bp, Bos taurus; identical to SEQ ID NO: 26901

SEQ ID NO: 107863 - DNA, 201 bp, Bos taurus; identical to SEQ ID NO: 26902

SEQ ID NO: 107864 - DNA, 201 bp, Bos taurus
gcgtcagctttattccaagcaatatttcctggattaactttccatagctttatggattaactaatattataatctctactgtatagaggatgagcttgaaacataaaagattgaacaatgtaaccaaaatcacaaagctaggaaatcttcaagtaaggtttggaatccaagtagcttacctccagcccatgcccttgacct

SEQ ID NO: 107865 - DNA, 201 bp, Bos taurus; identical to SEQ ID NO: 26903

SEQ ID NO: 107866 - DNA, 201 bp, Bos taurus; identical to SEQ ID NO: 26904

SEQ ID NO: 107867 - DNA, 201 bp, Bos taurus
acatatacaatgtgataccagcaagaataatccaagagatttgttttgatttacttttcatttcagggcttttaggattggcttgtaaaaaagacgctgagctataaagactacaaacactgatttccacaaaaccaaagactttggagttattttctaaactttttctgccatcctccatccacctaaatcttcactaag

SEQ ID NO: 107868 - DNA, 201 bp, Bos taurus
ataaatatcacaattcatttattgactttgcatcctaggaaatatcaagaagaattgtctgatatgagtttagaccttgggcttgctaaaaatcaatattcatctcttaggtcaatcaatttattgatattcatctcaatgagaagtcagtatgtatataatataactgtgggctaaatttctacacagaaatattataaa

SEQ ID NO: 107869 - DNA, 201 bp, Bos taurus; identical to SEQ ID NO: 26905

SEQ ID NO: 107870 - DNA, 201 bp, Bos taurus; identical to SEQ ID NO: 26906

SEQ ID NO: 107871 - DNA, 201 bp, Bos taurus; identical to SEQ ID NO: 26907

SEQ ID NO: 107872 - DNA, 201 bp, Bos taurus; identical to SEQ ID NO: 26908

SEQ ID NO: 107873 - DNA, 201 bp, Bos taurus; identical to SEQ ID NO: 26910

SEQ ID NO: 107874 - DNA, 201 bp, Bos taurus; identical to SEQ ID NO: 26911

SEQ ID NO: 107875 - DNA, 201 bp, Bos taurus; identical to SEQ ID NO: 26912

SEQ ID NO: 107876 - DNA, 201 bp, Bos taurus; identical to SEQ ID NO: 26913

SEQ ID NO: 107877 - DNA, 201 bp, Bos taurus; identical to SEQ ID NO: 26914

SEQ ID NO: 107878 - DNA, 201 bp, Bos taurus; identical to SEQ ID NO: 26915

SEQ ID NO: 107879 - DNA, 201 bp, Bos taurus; identical to SEQ ID NO: 26916

SEQ ID NO: 107880 - DNA, 201 bp, Bos taurus; identical to SEQ ID NO: 26917

SEQ ID NO: 107881 - DNA, 201 bp, Bos taurus; identical to SEQ ID NO: 26918

SEQ ID NO: 107882 - DNA, 201 bp, Bos taurus; identical to SEQ ID NO: 26919

SEQ ID NO: 107883 - DNA, 201 bp, Bos taurus; identical to SEQ ID NO: 26920

SEQ ID NO: 107884 - DNA, 201 bp, Bos taurus; identical to SEQ ID NO: 26921

SEQ ID NO: 107885 - DNA, 201 bp, Bos taurus; identical to SEQ ID NO: 26922

SEQ ID NO: 107886 - DNA, 201 bp, Bos taurus; identical to SEQ ID NO: 26923

SEQ ID NO: 107887 - DNA, 201 bp, Bos taurus; identical to SEQ ID NO: 26924

SEQ ID NO: 107888 - DNA, 201 bp, Bos taurus; identical to SEQ ID NO: 26925

SEQ ID NO: 107889 - DNA, 201 bp, Bos taurus; identical to SEQ ID NO: 26926

SEQ ID NO: 107890 - DNA, 201 bp, Bos taurus; identical to SEQ ID NO: 26927

SEQ ID NO: 107891 - DNA, 201 bp, Bos taurus; identical to SEQ ID NO: 26928

SEQ ID NO: 107892 - DNA, 201 bp, Bos taurus; identical to SEQ ID NO: 26929

SEQ ID NO: 107893 - DNA, 201 bp, Bos taurus; identical to SEQ ID NO: 26930

SEQ ID NO: 107894 - DNA, 201 bp, Bos taurus; identical to SEQ ID NO: 26931

SEQ ID NO: 107895 - DNA, 201 bp, Bos taurus; identical to SEQ ID NO: 26932

SEQ ID NO: 107896 - DNA, 201 bp, Bos taurus; identical to SEQ ID NO: 26933

SEQ ID NO: 107897 - DNA, 201 bp, Bos taurus; identical to SEQ ID NO: 26934

SEQ ID NO: 107898 - DNA, 201 bp, Bos taurus; identical to SEQ ID NO: 26935

SEQ ID NO: 107899 - DNA, 201 bp, Bos taurus; identical to SEQ ID NO: 26937

SEQ ID NO: 107900 - DNA, 201 bp, Bos taurus
tacttctttatcccctaattatgccttcccatcaagtttgaatatctacccttaagacgatttcatgagctagataaaatagaacaagcttcttatacagttcacagtctccacacatcagttagtatacctagcgttctaccacatatatgacaggtgagtttatatatgggatacttatattttataatgtaacagcat

SEQ ID NO: 107901 - DNA, 201 bp, Bos taurus
gttgaggccacactgacatgtaatctttggacttcaccaaagttggggctgagggtacaatgtgcatccttgattcttctattcctgaccttccccaggatgcacttctcagtctttgctttgtgagtccacctaaaaccctgctggggcaaacatcagagactgcttaactcgggaggaccctgttctcatttctctttc

SEQ ID NO: 107902 - DNA, 201 bp, Bos taurus; identical to SEQ ID NO: 26938

SEQ ID NO: 107903 - DNA, 201 bp, Bos taurus; identical to SEQ ID NO: 26939

SEQ ID NO: 107904 - DNA, 201 bp, Bos taurus
attatatgtagtgctctctcatcatacatacctcatgctcaccggtataacacctttatgaatatttctcttaatttcccttctaaagcttgtattttttgtatattacaagccttcagtaaatatttgccaagcaaatgaatagacagtcaaatttaacactagattgaaagtctcttcagattaaaactttcttctgta

SEQ ID NO: 107905 - DNA, 201 bp, Bos taurus
atattttctctgaagatggcctaaaaaaagtcagttacaaccagcattcaccccagcgatgattgcacaagcacaaccatgaaagaaagaaaggccaggcaaatcagttgagcagtaagtacttaggcaatctttcctagtgactgttgtcattgccgctggactttagaactgaacatgtttacatttaattagaaagga

SEQ ID NO: 107906 - DNA, 201 bp, Bos taurus
cagaaggcaagcctcattggaagccgtgtcagaagccaccttcctcaaagttttcagaaggttatttttattgggccttagggagctaagataatcacaatggtatgatcactcacctatagccagacatcctggaatgtgaagtcaagtgggccttagaaagcatcactacaaacaaagctagtggaggtgatggaattc

SEQ ID NO: 107907 - DNA, 201 bp, Bos taurus
tcttttcttgccccctggagtaaatgtcaagcagcaatagaagtttagcttttgcagatgctctgcttcttcagatttctctctttcttggtattgtgttcttgctttttccggttcctgcatggtcagtcagtcagttcagttgctcagtcgtgtctgactctttgcgaccccatgaactgcagcacaccaggcctccct

SEQ ID NO: 107908 - DNA, 201 bp, Bos taurus; identical to SEQ ID NO: 26940

SEQ ID NO: 107909 - DNA, 201 bp, Bos taurus; identical to SEQ ID NO: 26944

SEQ ID NO: 107910 - DNA, 201 bp, Bos taurus
gtacagaatcaggtgccaagcagacaaaatcttgagttcagtagtcaccaaaaaagggagcgcttttaagcctcccatgccccaggctttgaattggaaccccaagttactatatactctaggaataggttgaaccagaagtattaattgccagttttcaaagggactgaatgaaccttactggattgttatctgagattc

SEQ ID NO: 107911 - DNA, 201 bp, Bos taurus
actgatcctcaagaagaaagctcatttctaagtagacaaatagcagtggaagatgagaatgacccagaggaattaaacagtggtgagccccaaacagaacataagcaagaacttgaattagagtttgattcagtgccaaaggaacagtctgaactgttagtatctgagttagagcatagtctcaatcctcaagacactggt

SEQ ID NO: 107912 - DNA, 201 bp, Bos taurus; identical to SEQ ID NO: 26945

SEQ ID NO: 107913 - DNA, 201 bp, Bos taurus; identical to SEQ ID NO: 26946

SEQ ID NO: 107914 - DNA, 201 bp, Bos taurus
agtaattgaattactgaagcaatgtaggtaaactgaatgaagataacaaagaaaacgtggaagaactctaaaggacacaagttaaaaaagcatgtgtgagcaatgtaactaatagcatcagtcaacaacaatcccaccagttttctaaaaacaatttctagttatttataaatatttataaataatctaagtgcaatgtat

SEQ ID NO: 107915 - DNA, 201 bp, Bos taurus
attggttcattaagcaattcaatcccaaactgtaaaaagtttaagtttaatcctgcctgaagcctgactgatcctgtcataaacacttttgataaaccttgcacttaaacctggtcttgcagttttattaatctaacaataattcaaagtgacatcccatgtagcaatataaatctataagatggatgtcataaaacttac

SEQ ID NO: 107916 - DNA, 201 bp, Bos taurus
taagggatctcctgtatttgagacacacttttccttacctccattttagaggagtcatcccattccttcttggttgtcaggcccagtcaccccagctggaactgtaagtcccttttcttgcctgttgattgagaggcagaaggaacccaaagtggccaggtgactgtcttaactcctactttagtgggatcattcttgtgt

SEQ ID NO: 107917 - DNA, 201 bp, Bos taurus; identical to SEQ ID NO: 26947

SEQ ID NO: 107918 - DNA, 201 bp, Bos taurus; identical to SEQ ID NO: 26949

SEQ ID NO: 107919 - DNA, 201 bp, Bos taurus; identical to SEQ ID NO: 26954

SEQ ID NO: 107920 - DNA, 201 bp, Bos taurus; identical to SEQ ID NO: 26955

SEQ ID NO: 107921 - DNA, 201 bp, Bos taurus; identical to SEQ ID NO: 26959

SEQ ID NO: 107922 - DNA, 201 bp, Bos taurus; identical to SEQ ID NO: 26960

SEQ ID NO: 107923 - DNA, 201 bp, Bos taurus; identical to SEQ ID NO: 26961

SEQ ID NO: 107924 - DNA, 201 bp, Bos taurus
atggacaggaaggcctggcgtgctgcgattcatggggtcgcaaagattcggacatgactgagcaactgaactgaactgaaggactgatgaacctactctggaacaaggtaattatattcataggccttacaattacttatacataattcagagtattcaattaaaaaaacactcacaatttagattacagaccacacttaa

SEQ ID NO: 107925 - DNA, 201 bp, Bos taurus; identical to SEQ ID NO: 26962

SEQ ID NO: 107926 - DNA, 201 bp, Bos taurus; identical to SEQ ID NO: 26963

SEQ ID NO: 107927 - DNA, 201 bp, Bos taurus
taggttatggatgtttttctccagccttttgagataatttacatataacattgttcattgtttaaggtgcacaatatgttgatttgatggacatagagggcaaaatgactactaccatagcatttattaatacctgcatcaaaattcataattaccattttctttttttgtgtgtgagaatatttaagatctactctgtag

SEQ ID NO: 107928 - DNA, 201 bp, Bos taurus; identical to SEQ ID NO: 26964

SEQ ID NO: 107929 - DNA, 201 bp, Bos taurus; identical to SEQ ID NO: 26965

SEQ ID NO: 107930 - DNA, 201 bp, Bos taurus; identical to SEQ ID NO: 26966

SEQ ID NO: 107931 - DNA, 201 bp, Bos taurus; identical to SEQ ID NO: 26967

SEQ ID NO: 107932 - DNA, 201 bp, Bos taurus; identical to SEQ ID NO: 26968

SEQ ID NO: 107933 - DNA, 201 bp, Bos taurus; identical to SEQ ID NO: 26969

SEQ ID NO: 107934 - DNA, 201 bp, Bos taurus; identical to SEQ ID NO: 26970

SEQ ID NO: 107935 - DNA, 201 bp, Bos taurus; identical to SEQ ID NO: 26971

SEQ ID NO: 107936 - DNA, 201 bp, Bos taurus; identical to SEQ ID NO: 26972

SEQ ID NO: 107937 - DNA, 201 bp, Bos taurus; identical to SEQ ID NO: 26973

SEQ ID NO: 107938 - DNA, 201 bp, Bos taurus; identical to SEQ ID NO: 26974

SEQ ID NO: 107939 - DNA, 201 bp, Bos taurus; identical to SEQ ID NO: 26975

SEQ ID NO: 107940 - DNA, 201 bp, Bos taurus; identical to SEQ ID NO: 26976

SEQ ID NO: 107941 - DNA, 201 bp, Bos taurus; identical to SEQ ID NO: 26977

SEQ ID NO: 107942 - DNA, 201 bp, Bos taurus; identical to SEQ ID NO: 26978

SEQ ID NO: 107943 - DNA, 201 bp, Bos taurus; identical to SEQ ID NO: 26979

SEQ ID NO: 107944 - DNA, 201 bp, Bos taurus; identical to SEQ ID NO: 26980

SEQ ID NO: 107945 - DNA, 201 bp, Bos taurus; identical to SEQ ID NO: 26981

SEQ ID NO: 107946 - DNA, 201 bp, Bos taurus; identical to SEQ ID NO: 26982

SEQ ID NO: 107947 - DNA, 201 bp, Bos taurus; identical to SEQ ID NO: 26983

SEQ ID NO: 107948 - DNA, 201 bp, Bos taurus; identical to SEQ ID NO: 26984

SEQ ID NO: 107949 - DNA, 201 bp, Bos taurus; identical to SEQ ID NO: 26985

SEQ ID NO: 107950 - DNA, 201 bp, Bos taurus; identical to SEQ ID NO: 26986

SEQ ID NO: 107951 - DNA, 201 bp, Bos taurus; identical to SEQ ID NO: 26987

SEQ ID NO: 107952 - DNA, 201 bp, Bos taurus; identical to SEQ ID NO: 26988

SEQ ID NO: 107953 - DNA, 201 bp, Bos taurus; identical to SEQ ID NO: 26989

SEQ ID NO: 107954 - DNA, 201 bp, Bos taurus; identical to SEQ ID NO: 26990

SEQ ID NO: 107955 - DNA, 201 bp, Bos taurus; identical to SEQ ID NO: 26991

SEQ ID NO: 107956 - DNA, 201 bp, Bos taurus; identical to SEQ ID NO: 26992

SEQ ID NO: 107957 - DNA, 201 bp, Bos taurus; identical to SEQ ID NO: 26993

SEQ ID NO: 107958 - DNA, 201 bp, Bos taurus; identical to SEQ ID NO: 26994

SEQ ID NO: 107959 - DNA, 201 bp, Bos taurus; identical to SEQ ID NO: 26995

SEQ ID NO: 107960 - DNA, 201 bp, Bos taurus; identical to SEQ ID NO: 26996

SEQ ID NO: 107961 - DNA, 201 bp, Bos taurus; identical to SEQ ID NO: 26997

SEQ ID NO: 107962 - DNA, 201 bp, Bos taurus; identical to SEQ ID NO: 26998

SEQ ID NO: 107963 - DNA, 201 bp, Bos taurus; identical to SEQ ID NO: 26999

SEQ ID NO: 107964 - DNA, 201 bp, Bos taurus; identical to SEQ ID NO: 27000

SEQ ID NO: 107965 - DNA, 201 bp, Bos taurus; identical to SEQ ID NO: 27001

SEQ ID NO: 107966 - DNA, 201 bp, Bos taurus; identical to SEQ ID NO: 27002

SEQ ID NO: 107967 - DNA, 201 bp, Bos taurus; identical to SEQ ID NO: 27003

SEQ ID NO: 107968 - DNA, 201 bp, Bos taurus; identical to SEQ ID NO: 27004

SEQ ID NO: 107969 - DNA, 201 bp, Bos taurus; identical to SEQ ID NO: 27005

SEQ ID NO: 107970 - DNA, 201 bp, Bos taurus
gactgctaggaatcagtggtagtgatgacaaaagaaaccaagccctagtgaggacaagagtcagggcccagcgaggaacagaatcagggcccattaaggatcagggtcaggatgtagtagggacaaggatcaggtcctcgtgagcatgaaagtcaggctctaatgatgatgagagtcatgccgtagtgaggaccagattca

SEQ ID NO: 107971 - DNA, 201 bp, Bos taurus
atgctgcggttcatggggtcgcaaagagtcagacacaactgagtgactgaactgaactgaactgaggatgcccttgcatggcctcacatgtcctctcacaaccttgtttgccctcaaatgctcttacacagtctcacacagccacaaacgtactcccaagccctcacacaaccacacacgccctcacacacccttgcaggc

SEQ ID NO: 107972 - DNA, 201 bp, Bos taurus
ttagtctatatcgttggtgacaaacacattttgatataaacattcctcaaaggacattgctggttagaatatcagtactgaatctaaagtatacaaacacgtaaacacacatgcacatacacacttgaaagctacagaaaatgtaccacacttgtggccctgagaaattcttacaacttgaaaatctaagatggtggctca

SEQ ID NO: 107973 - DNA, 201 bp, Bos taurus; identical to SEQ ID NO: 27006

SEQ ID NO: 107974 - DNA, 201 bp, Bos taurus; identical to SEQ ID NO: 27007

SEQ ID NO: 107975 - DNA, 201 bp, Bos taurus; identical to SEQ ID NO: 27008

SEQ ID NO: 107976 - DNA, 201 bp, Bos taurus; identical to SEQ ID NO: 27009

SEQ ID NO: 107977 - DNA, 201 bp, Bos taurus; identical to SEQ ID NO: 27010

SEQ ID NO: 107978 - DNA, 201 bp, Bos taurus; identical to SEQ ID NO: 27011

SEQ ID NO: 107979 - DNA, 201 bp, Bos taurus; identical to SEQ ID NO: 27012

SEQ ID NO: 107980 - DNA, 201 bp, Bos taurus; identical to SEQ ID NO: 27014

SEQ ID NO: 107981 - DNA, 201 bp, Bos taurus; identical to SEQ ID NO: 27015

SEQ ID NO: 107982 - DNA, 201 bp, Bos taurus; identical to SEQ ID NO: 27016

SEQ ID NO: 107983 - DNA, 201 bp, Bos taurus; identical to SEQ ID NO: 27017

SEQ ID NO: 107984 - DNA, 201 bp, Bos taurus; identical to SEQ ID NO: 27018

SEQ ID NO: 107985 - DNA, 201 bp, Bos taurus; identical to SEQ ID NO: 27019

SEQ ID NO: 107986 - DNA, 201 bp, Bos taurus; identical to SEQ ID NO: 27020

SEQ ID NO: 107987 - DNA, 201 bp, Bos taurus; identical to SEQ ID NO: 27021

SEQ ID NO: 107988 - DNA, 201 bp, Bos taurus; identical to SEQ ID NO: 27022

SEQ ID NO: 107989 - DNA, 201 bp, Bos taurus; identical to SEQ ID NO: 27023

SEQ ID NO: 107990 - DNA, 201 bp, Bos taurus; identical to SEQ ID NO: 27024

SEQ ID NO: 107991 - DNA, 201 bp, Bos taurus; identical to SEQ ID NO: 27025

SEQ ID NO: 107992 - DNA, 201 bp, Bos taurus; identical to SEQ ID NO: 27026

SEQ ID NO: 107993 - DNA, 201 bp, Bos taurus; identical to SEQ ID NO: 27027

SEQ ID NO: 107994 - DNA, 201 bp, Bos taurus; identical to SEQ ID NO: 27028

SEQ ID NO: 107995 - DNA, 201 bp, Bos taurus; identical to SEQ ID NO: 27029

SEQ ID NO: 107996 - DNA, 201 bp, Bos taurus; identical to SEQ ID NO: 27030

SEQ ID NO: 107997 - DNA, 201 bp, Bos taurus; identical to SEQ ID NO: 27031

SEQ ID NO: 107998 - DNA, 201 bp, Bos taurus; identical to SEQ ID NO: 27032

SEQ ID NO: 107999 - DNA, 201 bp, Bos taurus; identical to SEQ ID NO: 27033

SEQ ID NO: 108000 - DNA, 201 bp, Bos taurus; identical to SEQ ID NO: 27034

SEQ ID NO: 108001 - DNA, 201 bp, Bos taurus
cagccaaagaaatgaataaatattaaaacgaacaagcaaaatgccttcaaattccagccacttctagctgtttgcatctggaatcccagcgtgtaggccatgctcacaagagacagcgtcttagactaacagaatgaattaactccacgtggggaggagttaccttgagctcctggtctccaaagagtaacaggctgagct

SEQ ID NO: 108002 - DNA, 201 bp, Bos taurus
ctatatatagcagtgtgtatgctgatattttttaggactagatttcacagcatcggttgaatctctggcaactgcaaaggccacaaggccaggtagcagtggtcctgctgggatgagcatgcctcctccagtgtgagtttttgttatactcagaagcttacccacctggccctggcaggcccttgaatttgagacccgtaa

SEQ ID NO: 108003 - DNA, 201 bp, Bos taurus
ccaagccctctggacaccttgatgcaaatacagacgggagagtgcaaaagattttcttctttcttcttcaactccttccttggagttgtccaaggaaggctggacaactcatgttttattgctaaaccaaagttgctatcttggggtttggggattttttgtggttttgttttgctttgacatctagtgacagaaaatgag

SEQ ID NO: 108004 - DNA, 201 bp, Bos taurus
atggccctctgcaagttgctgtcattgttttcaaatgctttgtagttgggctgcccagatctggtcttcgcgatgggatggtgacaaaaagggttgcggaggctacagggtggcctgcctgtcacacaagtgcagccccagtgaaactgatgggagattaataggaaataatgggaccctgagtagagcactcgtgtggct

SEQ ID NO: 108005 - DNA, 201 bp, Bos taurus; identical to SEQ ID NO: 27035

SEQ ID NO: 108006 - DNA, 201 bp, Bos taurus
agaaatcatcattttgacacataaatcagcataaaatatcaatgagatagtttacgtatcttttttattccccactaaatcttgtggtattttacactcaaggcacatctcagtttgatctacctgcatagtttgatctactgggaagtgcttaacagtgacacatgctaccgcctactgccacgcacagtttcagtctgg

SEQ ID NO: 108007 - DNA, 201 bp, Bos taurus
aggggcccaggaataatgaaaagaagagtgagattacctttcattgacaaagacgactatacttactctaagtgacaacagaaggaggccaagaagataattgaaggatcctgaagatcaaagggctagaggatttgctctctctttggcacaagggtctagaattgcaaaaaccagaacaaatgtaggatgctaaaatgc

SEQ ID NO: 108008 - DNA, 201 bp, Bos taurus
agttacacacctcccagcaggtcttcctccctgcttggccccagacggttcataatcacttctcttgacatccttggactactgatgttgagaaagcctaagaaccacggccctgtctcaagatgggtcccaagagaacagtgtaccagccaggatttttcttttatattgacctgggttcaagtcccagtatcccacttg

SEQ ID NO: 108009 - DNA, 201 bp, Bos taurus
cactgaaagcctcacaggccaacagctaatggctgaggaacctggtcaaggctattcacctccattaccagacacctccaccctttccaaagcccctgctctcctttcttctggccttccttggcctgctcagtgtggattagacccggggtggctccttcctgctctcccatgaccttaggtcttattatattagaccca

SEQ ID NO: 108010 - DNA, 201 bp, Bos taurus
gctcagttggtaaagaatctacctgtaaagcacgagaccctggttcaatttctgggtagggaagatctgctagagaaaagaaaaagctaccatctggcctcgagtactagtcccttggactgcaaggagatcaaaccagtccatcctaaaggaaatcagtcctgaatattcattggaaggactaatgctgaagctaaaact

SEQ ID NO: 108011 - DNA, 201 bp, Bos taurus; identical to SEQ ID NO: 27036

SEQ ID NO: 108012 - DNA, 201 bp, Bos taurus
tgcatatatatatatatatatatatatatatatatatatatcatacatatgatatatacatatctctcagattcttaaatatatacatacaaaatgtgtgtgtgtgtgtaactgaaccactgcacacctgaaattaatacagcactgtaaatcaagtacacttcaaataagaaaacaattttttttttaatttctgctaaa

SEQ ID NO: 108013 - DNA, 201 bp, Bos taurus; identical to SEQ ID NO: 27037

SEQ ID NO: 108014 - DNA, 201 bp, Bos taurus
aagggatttccaaagtcacccaaggagtaccaacagatccgagtctggaaacaaaggtctgtccaatcatgatgataataataccagctaacgatgggagctgtctgctcagcccttggtgggtgttactcctttaaccctcatgggccccaggggagtcacacccaggccctgcatgtctccagcatactcgcctgcctg

SEQ ID NO: 108015 - DNA, 201 bp, Bos taurus; identical to SEQ ID NO: 27038

SEQ ID NO: 108016 - DNA, 201 bp, Bos taurus; identical to SEQ ID NO: 27039

SEQ ID NO: 108017 - DNA, 201 bp, Bos taurus
tctaaaaatatctttgccatccttgcccttaaagtatagtttggctgggtatagaatcataggttcacaattaatctctttcaacttcaaaaatattttttgatttccttctggcgtatgttgttgttcatgacaagttggctaacaatctgatttgtgctctgatttgttgagagaaatttatgcttcattctctggtga

SEQ ID NO: 108018 - DNA, 201 bp, Bos taurus; identical to SEQ ID NO: 27040

SEQ ID NO: 108019 - DNA, 201 bp, Bos taurus
taaaagatgtggtccaccttgtctaacccaccagggctagaatgacgcactgaattctcacatcagactgtctgccagcatcagtcccaggcagagtcagtgcgcagagcaaaagcaggaagcacgcaaccccaacggcaccaacagcaaaaccccacccacaccccggctctcagatccaaggaggccaggcagcctgga

SEQ ID NO: 108020 - DNA, 201 bp, Bos taurus
ctgcaaggcatggtcctacatgggacatgctcagtatatctttaatccaattttctgctgatgggtgtggctgtgttccctcccggtagtttggcctgaggtcaaactgtggtagcagtaattggaaaactgctaatggaaacctccttcaaaaggacttaggccagcaccctgcagttcccaggactgttgtattcagtg

SEQ ID NO: 108021 - DNA, 201 bp, Bos taurus; identical to SEQ ID NO: 27041

SEQ ID NO: 108022 - DNA, 201 bp, Bos taurus; identical to SEQ ID NO: 27044

SEQ ID NO: 108023 - DNA, 201 bp, Bos taurus; identical to SEQ ID NO: 27045

SEQ ID NO: 108024 - DNA, 201 bp, Bos taurus; identical to SEQ ID NO: 27048

SEQ ID NO: 108025 - DNA, 201 bp, Bos taurus; identical to SEQ ID NO: 27049

SEQ ID NO: 108026 - DNA, 201 bp, Bos taurus; identical to SEQ ID NO: 27050

SEQ ID NO: 108027 - DNA, 201 bp, Bos taurus; identical to SEQ ID NO: 27051

SEQ ID NO: 108028 - DNA, 201 bp, Bos taurus; identical to SEQ ID NO: 27052

SEQ ID NO: 108029 - DNA, 201 bp, Bos taurus; identical to SEQ ID NO: 27054

SEQ ID NO: 108030 - DNA, 201 bp, Bos taurus; identical to SEQ ID NO: 27058

SEQ ID NO: 108031 - DNA, 201 bp, Bos taurus; identical to SEQ ID NO: 27064

SEQ ID NO: 108032 - DNA, 201 bp, Bos taurus; identical to SEQ ID NO: 27066

SEQ ID NO: 108033 - DNA, 201 bp, Bos taurus; identical to SEQ ID NO: 27067

SEQ ID NO: 108034 - DNA, 201 bp, Bos taurus; identical to SEQ ID NO: 27068

SEQ ID NO: 108035 - DNA, 201 bp, Bos taurus; identical to SEQ ID NO: 27071

SEQ ID NO: 108036 - DNA, 201 bp, Bos taurus; identical to SEQ ID NO: 27072

SEQ ID NO: 108037 - DNA, 201 bp, Bos taurus; identical to SEQ ID NO: 27073

SEQ ID NO: 108038 - DNA, 201 bp, Bos taurus; identical to SEQ ID NO: 27074

SEQ ID NO: 108039 - DNA, 201 bp, Bos taurus; identical to SEQ ID NO: 27075

SEQ ID NO: 108040 - DNA, 201 bp, Bos taurus; identical to SEQ ID NO: 27078

SEQ ID NO: 108041 - DNA, 201 bp, Bos taurus; identical to SEQ ID NO: 27081

SEQ ID NO: 108042 - DNA, 201 bp, Bos taurus; identical to SEQ ID NO: 27083

SEQ ID NO: 108043 - DNA, 201 bp, Bos taurus; identical to SEQ ID NO: 27084

SEQ ID NO: 108044 - DNA, 201 bp, Bos taurus
ccaacagccacatgtgggagtgtctgagagttgtgctgtctcacaattcaagttgttatttaacctgtggtagctctgaagctcatgctcccaggggttccgctagacatgggtgtgcatcttcctaccacccgcgctgctgctaagttcagaggaggcccaaactgggaacctgccttcccaagcctctcacctgctgat

SEQ ID NO: 108045 - DNA, 201 bp, Bos taurus; identical to SEQ ID NO: 27085

SEQ ID NO: 108046 - DNA, 201 bp, Bos taurus; identical to SEQ ID NO: 27086

SEQ ID NO: 108047 - DNA, 201 bp, Bos taurus; identical to SEQ ID NO: 27087

SEQ ID NO: 108048 - DNA, 201 bp, Bos taurus
tgtaacagcttttgtcacaacatcaattcaccatcccttggttttaatccagctgtactaggcagtgaaggagaaactaaaaacatggacagatggtgctatgaagttgggatttggcaacacagctttggtgaaaagacaagaaggtgagaaaagtgcagtgttgatgtactgttgtaaaatgatctgtcattctgctca

SEQ ID NO: 108049 - DNA, 201 bp, Bos taurus
attttctcccaaatattgctgttggaaggttgccaaatcaccggtgatgctgccagagctgaagttagatgttgcctggttaactcaggcctccaagaaggtcaaaatcagcttgagaacaagagtgtcctgtatctaagggggacatggtgataaatgatggccattctgattttcacaatggcaagtgcattggtgtgg

SEQ ID NO: 108050 - DNA, 201 bp, Bos taurus; identical to SEQ ID NO: 27088

SEQ ID NO: 108051 - DNA, 201 bp, Bos taurus; identical to SEQ ID NO: 27089

SEQ ID NO: 108052 - DNA, 201 bp, Bos taurus; identical to SEQ ID NO: 27090

SEQ ID NO: 108053 - DNA, 201 bp, Bos taurus; identical to SEQ ID NO: 27091

SEQ ID NO: 108054 - DNA, 201 bp, Bos taurus; identical to SEQ ID NO: 27093

SEQ ID NO: 108055 - DNA, 201 bp, Bos taurus
gaggagagagcctcgagaatgaggagtatagcggccgaccgaccgattgagagtgatcatcaaagctgatcctcttacacttacagcagaagttaccaaaacactcagggccaaacaatctacagtcattcagcatttgaagcaaactggaaaggtgaaaaagctcagtgagtgtctcgtgagctgaccacaaatccaaaa

SEQ ID NO: 108056 - DNA, 201 bp, Bos taurus
atctttgtgtgcttgtgttgcacagcgaggccaaacaaatcaaaacacggcagtgtggagcagagaaaggtttactgcagggccaagcaaggggaatgggtggcttgtgttcaaaaacctggaactctcccctgggtttcagcaaagcatttgtaaaggccaggtaaggtagggggactgcaggatatgtgattagccctt

SEQ ID NO: 108057 - DNA, 201 bp, Bos taurus
tcttcctccagcccacgggccagggtagcatgagactagtgcacatgtgcagatggcatcagcaagctcactgcagagtcaaaattaggatgcaagtcagtttgagtcattacgaaggcttggggcctctaagctaatttacggtgacctgcggaggctaaaatgaggcagaatctggactgttctaccattatgagactc

SEQ ID NO: 108058 - DNA, 201 bp, Bos taurus; identical to SEQ ID NO: 27097

SEQ ID NO: 108059 - DNA, 201 bp, Bos taurus
cactgtctacaatgcttactacccggctctatacagagaaagttggccaagccctaatctggcaatataggcaaagcacttttaatacagtaatctagcatggagtaagtactggtaatttatagatatttttatttttacctctgaaggccaaatctgcatcactaatgcctttgttattggcaatttgatgttagatgc

SEQ ID NO: 108060 - DNA, 201 bp, Bos taurus; identical to SEQ ID NO: 27100

SEQ ID NO: 108061 - DNA, 201 bp, Bos taurus
tgaactgtaggcagaaatttcgctggggggtcggggggcagcattgcaggaagaggcaggaccatatcccaagatattcaacagctggtgtaaagaggagcggtgggatctgaaaatagcccagcttccagctcccatcagggcagagacagtgcacaacagcctcaacaggactggaaggacacagcgccttggcagcca

SEQ ID NO: 108062 - DNA, 201 bp, Bos taurus
ttggtcccttgggaaaccaaagcagttgtatacgatggcacgcttctctttgttgctcagataattttcatcgccattggcccagactaagccttgcagacgaagcacatcctcaggacagtccagcagaattgggctctgctctgtctacggtgacagcagagtcatctcaagtggaaccgggccattgttccctcccag

SEQ ID NO: 108063 - DNA, 201 bp, Bos taurus
ctatccttgctgaaaccctcttaagatacaggtcaaaataatgcacatttcattcacccacaggaggtgcaagaaaggccccagtgccctcgttatcactggtctccctttgttctctgtctccctgacaccccagcctgttccgccgatacactgcgctacttccggccaaggacctctgcacatgcgctgttagcagtc

SEQ ID NO: 108064 - DNA, 201 bp, Bos taurus; identical to SEQ ID NO: 27101

SEQ ID NO: 108065 - DNA, 201 bp, Bos taurus; identical to SEQ ID NO: 27103

SEQ ID NO: 108066 - DNA, 201 bp, Bos taurus; identical to SEQ ID NO: 27104

SEQ ID NO: 108067 - DNA, 201 bp, Bos taurus; identical to SEQ ID NO: 27105

SEQ ID NO: 108068 - DNA, 201 bp, Bos taurus; identical to SEQ ID NO: 27106

SEQ ID NO: 108069 - DNA, 201 bp, Bos taurus; identical to SEQ ID NO: 27107

SEQ ID NO: 108070 - DNA, 201 bp, Bos taurus; identical to SEQ ID NO: 27108

SEQ ID NO: 108071 - DNA, 201 bp, Bos taurus; identical to SEQ ID NO: 27109

SEQ ID NO: 108072 - DNA, 201 bp, Bos taurus; identical to SEQ ID NO: 27113

SEQ ID NO: 108073 - DNA, 201 bp, Bos taurus; identical to SEQ ID NO: 27114

SEQ ID NO: 108074 - DNA, 201 bp, Bos taurus; identical to SEQ ID NO: 27115

SEQ ID NO: 108075 - DNA, 201 bp, Bos taurus; identical to SEQ ID NO: 27118

SEQ ID NO: 108076 - DNA, 201 bp, Bos taurus; identical to SEQ ID NO: 27119

SEQ ID NO: 108077 - DNA, 201 bp, Bos taurus; identical to SEQ ID NO: 27121

SEQ ID NO: 108078 - DNA, 201 bp, Bos taurus; identical to SEQ ID NO: 27122

SEQ ID NO: 108079 - DNA, 201 bp, Bos taurus; identical to SEQ ID NO: 27123

SEQ ID NO: 108080 - DNA, 201 bp, Bos taurus; identical to SEQ ID NO: 27128

SEQ ID NO: 108081 - DNA, 201 bp, Bos taurus; identical to SEQ ID NO: 27129

SEQ ID NO: 108082 - DNA, 201 bp, Bos taurus; identical to SEQ ID NO: 27130

SEQ ID NO: 108083 - DNA, 201 bp, Bos taurus; identical to SEQ ID NO: 27131

SEQ ID NO: 108084 - DNA, 201 bp, Bos taurus; identical to SEQ ID NO: 27132

SEQ ID NO: 108085 - DNA, 201 bp, Bos taurus; identical to SEQ ID NO: 27133

SEQ ID NO: 108086 - DNA, 201 bp, Bos taurus; identical to SEQ ID NO: 27134

SEQ ID NO: 108087 - DNA, 201 bp, Bos taurus; identical to SEQ ID NO: 27135

SEQ ID NO: 108088 - DNA, 201 bp, Bos taurus; identical to SEQ ID NO: 27136

SEQ ID NO: 108089 - DNA, 201 bp, Bos taurus; identical to SEQ ID NO: 27137

SEQ ID NO: 108090 - DNA, 201 bp, Bos taurus; identical to SEQ ID NO: 27138

SEQ ID NO: 108091 - DNA, 201 bp, Bos taurus; identical to SEQ ID NO: 27139

SEQ ID NO: 108092 - DNA, 201 bp, Bos taurus; identical to SEQ ID NO: 27140

SEQ ID NO: 108093 - DNA, 201 bp, Bos taurus; identical to SEQ ID NO: 27141

SEQ ID NO: 108094 - DNA, 201 bp, Bos taurus; identical to SEQ ID NO: 27143

SEQ ID NO: 108095 - DNA, 201 bp, Bos taurus; identical to SEQ ID NO: 27145

SEQ ID NO: 108096 - DNA, 201 bp, Bos taurus; identical to SEQ ID NO: 27146

SEQ ID NO: 108097 - DNA, 201 bp, Bos taurus
tgccggcctcgttgatggaagggatttagtcataggtaactactttgtgctctgcccttgtgcccttgtctctctgcctatatccttaggatctagaaaatcaggccttgattctactgagtaggtcgaatgattctaggaatggttcttggctttgttgaaataggaggtattggggatagttccttttttacaaaaaag

SEQ ID NO: 108098 - DNA, 201 bp, Bos taurus
catcatcttccctgttcaatctagagttcccccacgaggctggggacggggtgcttctccttctgcgggagggatccaggatctgccattgccgggccccaacctgaggctctgtcccacattatctcttctacttgtaggactcagggtggagttcatgttcacaaggatggcctgacagtgacctctccggtcctgatg

SEQ ID NO: 108099 - DNA, 201 bp, Bos taurus
gtgctggtgtgaggcatacagcctagagcaagaaggtgccggagccttccctgcctggtcacgcgggcttctgtggccctgatcccgcataacctgatgacgacaggtatgtaccactgccctaggagcacctgtgtgtgtcacatgtgggcacctgtacaggtgtgctatagttctgcccagttcccctctttgggccag

SEQ ID NO: 108100 - DNA, 201 bp, Bos taurus
ctggtatgtcaaaatcagaaaattgttacctaaaagtcccagatttcttggttcttttgaaaaacgagatgagctggcttcactgggcctgcacttcctcgtgcagagatctgctcggtgtctttggtggctcacacagtagatctcacctgtggtggtctcatggctgaaggactggagaattggaagcctcagtccagg

SEQ ID NO: 108101 - DNA, 201 bp, Bos taurus; identical to SEQ ID NO: 27147

SEQ ID NO: 108102 - DNA, 201 bp, Bos taurus; identical to SEQ ID NO: 27149

SEQ ID NO: 108103 - DNA, 201 bp, Bos taurus; identical to SEQ ID NO: 27150

SEQ ID NO: 108104 - DNA, 201 bp, Bos taurus; identical to SEQ ID NO: 27151

SEQ ID NO: 108105 - DNA, 201 bp, Bos taurus; identical to SEQ ID NO: 27152

SEQ ID NO: 108106 - DNA, 201 bp, Bos taurus; identical to SEQ ID NO: 27161

SEQ ID NO: 108107 - DNA, 201 bp, Bos taurus; identical to SEQ ID NO: 27162

SEQ ID NO: 108108 - DNA, 201 bp, Bos taurus; identical to SEQ ID NO: 27169

SEQ ID NO: 108109 - DNA, 201 bp, Bos taurus
actgttgttctcacactgccttgttgaacttccaagtgagtgttcatttggagtctgagacctagccgacatgccactgcttcctctggaagagaacatgataacatcaaagtcctgtgctttcttcgttttgcgctgatggggatatgtaggcttcttataatataaacttgtccaaggttctgttttgctatcatgact

SEQ ID NO: 108110 - DNA, 201 bp, Bos taurus; identical to SEQ ID NO: 27172

SEQ ID NO: 108111 - DNA, 201 bp, Bos taurus; identical to SEQ ID NO: 27175

SEQ ID NO: 108112 - DNA, 201 bp, Bos taurus
atttgtgtttcctcttaaatgttccccaggtgtctttttttttttttattattgcttctcttatttatataatatcatggaaaatgaccatggaaagatcggttcttttgaaatctatgcttaaaggtttcagaattcttaagcaagttacaaagaaagtcttgaattatgtatagaaaaacataaatttaaaaaatcagg

SEQ ID NO: 108113 - DNA, 201 bp, Bos taurus
cagctccttcagaaaatggccaagtgggggaattcatcagaaatccagcacaaggtgtcgttacattgccacatcttgacaagtcagagctacacaactttagaggacattggtatatccactgggatatagaaatagacgacataactgcaaagttaatttctgcctttgcataagtgctgaacaattgaaaatgcaaat

SEQ ID NO: 108114 - DNA, 201 bp, Bos taurus
ttctacacagcgattcccagtagtgaatggagttttagggcaacactatgtaaataatggtcaactgccattatcacctttgtagaaagaactggtcatatgagtttatgtgtaatgagcaatgtgcagagggaataaagtcagtaggcttgtatattccttcattgctgagaaccttctatatgaaaagcattacgaaaa

SEQ ID NO: 108115 - DNA, 201 bp, Bos taurus; identical to SEQ ID NO: 27181

SEQ ID NO: 108116 - DNA, 201 bp, Bos taurus; identical to SEQ ID NO: 27183

SEQ ID NO: 108117 - DNA, 201 bp, Bos taurus; identical to SEQ ID NO: 27187

SEQ ID NO: 108118 - DNA, 201 bp, Bos taurus; identical to SEQ ID NO: 27188

SEQ ID NO: 108119 - DNA, 201 bp, Bos taurus
gcagtgaacaaagtgctggacgacccgctcgttgatctcgctgcacagttggaagttgttcatgaagatgtgctgcatcgtgacggcttccaggatctgatgcgagagcaagggcacagagacaggatcaaaggaagggcgaggcgagaaagagtctatcccaacacaggcaggggcattcagccccgcgagagcatcttt

SEQ ID NO: 108120 - DNA, 201 bp, Bos taurus; identical to SEQ ID NO: 27189

SEQ ID NO: 108121 - DNA, 201 bp, Bos taurus; identical to SEQ ID NO: 27190

SEQ ID NO: 108122 - DNA, 201 bp, Bos taurus
ccttatctggggccttttccagttggtaacagacaaggccatttatctcaaaatttgaagaatccttagcaagaaaataacatcgcaagatgagatcaccagagaggcatggccaagagttcttcttctgccccttttcataatattccccactgtttatttactgattgaattgttgtggtgggagacacagtgtttgct

SEQ ID NO: 108123 - DNA, 201 bp, Bos taurus
actacagagatagaaagcaaacaccaagtaaagggctgatcatggtgtccttagcaaataaatgaatgaataaatagaaaaccacatgagagaagataatagattttagtattgtttgtttgtgaaagaatgaatgtaataccttttggccaatcacacaggcaaattagaaaatttgataatcaagcattgcatttgttt

SEQ ID NO: 108124 - DNA, 201 bp, Bos taurus; identical to SEQ ID NO: 27191

SEQ ID NO: 108125 - DNA, 201 bp, Bos taurus; identical to SEQ ID NO: 27192

SEQ ID NO: 108126 - DNA, 201 bp, Bos taurus; identical to SEQ ID NO: 27193

SEQ ID NO: 108127 - DNA, 201 bp, Bos taurus
tgaggcctagagatgttcagcaatgtgcccaaggtcttacagccagtaagtgggggacacaggcagggtgggttcatagcctatattcttaactgagaccagcttggccaccactgtggacaaacagctttcattttctggtctctgtttccatgaacacaaaacaaagggggttagagagcagaaagctcatggcccata

SEQ ID NO: 108128 - DNA, 201 bp, Bos taurus; identical to SEQ ID NO: 27194

SEQ ID NO: 108129 - DNA, 201 bp, Bos taurus
tacttctgttctcaggaaagccattaagttacattaaacaacagaaaacaagaaaatgttgaattaaagttgtaataagtttcccaaattgtaatagtaacataatactgtaaccattttcaatgctgtagataaaggaacaaaccatagttccaaacacaagtatcaaatggattgtgctaaggatcctaactaacatca

SEQ ID NO: 108130 - DNA, 201 bp, Bos taurus; identical to SEQ ID NO: 27195

SEQ ID NO: 108131 - DNA, 201 bp, Bos taurus; identical to SEQ ID NO: 27196

SEQ ID NO: 108132 - DNA, 201 bp, Bos taurus; identical to SEQ ID NO: 27197

SEQ ID NO: 108133 - DNA, 201 bp, Bos taurus; identical to SEQ ID NO: 27198

SEQ ID NO: 108134 - DNA, 201 bp, Bos taurus
cagtaagtaaggatattttttaatattaggaagtgcttgcagggttaaacctcctacatagcattttacttagtatataagagctatgatacatagaaacaacagaaaagaaaggaaactgttgggcaccccaatgcaatcttaatgtttccacttcagtaattttaatatgtgttattaatgatattatgctgtgacaaa

SEQ ID NO: 108135 - DNA, 201 bp, Bos taurus; identical to SEQ ID NO: 27199

SEQ ID NO: 108136 - DNA, 201 bp, Bos taurus; identical to SEQ ID NO: 27200

SEQ ID NO: 108137 - DNA, 201 bp, Bos taurus; identical to SEQ ID NO: 27201

SEQ ID NO: 108138 - DNA, 201 bp, Bos taurus
gctgtacagcagattggcaaacattgcaaatcaactcttcttcagtttaaaaactgtgaagatctatggaattatcttttttaaaatggtgttgacttttataaatcatagcaccttatatctgtacatggctggcattatgcagtatatgccctatgcatcataggcattacacacaatacctttccattatttttcatt

SEQ ID NO: 108139 - DNA, 201 bp, Bos taurus; identical to SEQ ID NO: 27202

SEQ ID NO: 108140 - DNA, 201 bp, Bos taurus; identical to SEQ ID NO: 27203

SEQ ID NO: 108141 - DNA, 201 bp, Bos taurus
agtttactctcttggggatccaacttctgttgggtccatgacgcagcatttctctttctcaggctttatctgctcatggtttatgaatgtaaatatgacttattaaaatcctggtttgagatcatacagaaacaggtcatttctggcccctgaataatcttctctattttaaaattagcttctgtatgaaaaagttatctc

SEQ ID NO: 108142 - DNA, 201 bp, Bos taurus; identical to SEQ ID NO: 27204

SEQ ID NO: 108143 - DNA, 201 bp, Bos taurus; identical to SEQ ID NO: 27205

SEQ ID NO: 108144 - DNA, 201 bp, Bos taurus; identical to SEQ ID NO: 27206

SEQ ID NO: 108145 - DNA, 201 bp, Bos taurus; identical to SEQ ID NO: 27207

SEQ ID NO: 108146 - DNA, 201 bp, Bos taurus; identical to SEQ ID NO: 27208

SEQ ID NO: 108147 - DNA, 201 bp, Bos taurus; identical to SEQ ID NO: 27209

SEQ ID NO: 108148 - DNA, 201 bp, Bos taurus; identical to SEQ ID NO: 27210

SEQ ID NO: 108149 - DNA, 201 bp, Bos taurus; identical to SEQ ID NO: 27211

SEQ ID NO: 108150 - DNA, 201 bp, Bos taurus; identical to SEQ ID NO: 27212

SEQ ID NO: 108151 - DNA, 201 bp, Bos taurus; identical to SEQ ID NO: 27213

SEQ ID NO: 108152 - DNA, 201 bp, Bos taurus; identical to SEQ ID NO: 27214

SEQ ID NO: 108153 - DNA, 201 bp, Bos taurus; identical to SEQ ID NO: 27215

SEQ ID NO: 108154 - DNA, 201 bp, Bos taurus; identical to SEQ ID NO: 27216

SEQ ID NO: 108155 - DNA, 201 bp, Bos taurus; identical to SEQ ID NO: 27217

SEQ ID NO: 108156 - DNA, 201 bp, Bos taurus; identical to SEQ ID NO: 27218

SEQ ID NO: 108157 - DNA, 201 bp, Bos taurus; identical to SEQ ID NO: 27219

SEQ ID NO: 108158 - DNA, 201 bp, Bos taurus; identical to SEQ ID NO: 27220

SEQ ID NO: 108159 - DNA, 201 bp, Bos taurus; identical to SEQ ID NO: 27221

SEQ ID NO: 108160 - DNA, 201 bp, Bos taurus; identical to SEQ ID NO: 27222

SEQ ID NO: 108161 - DNA, 201 bp, Bos taurus; identical to SEQ ID NO: 27223

SEQ ID NO: 108162 - DNA, 201 bp, Bos taurus; identical to SEQ ID NO: 27224

SEQ ID NO: 108163 - DNA, 201 bp, Bos taurus; identical to SEQ ID NO: 27225

SEQ ID NO: 108164 - DNA, 201 bp, Bos taurus; identical to SEQ ID NO: 27226

SEQ ID NO: 108165 - DNA, 201 bp, Bos taurus; identical to SEQ ID NO: 27227

SEQ ID NO: 108166 - DNA, 201 bp, Bos taurus; identical to SEQ ID NO: 27228

SEQ ID NO: 108167 - DNA, 201 bp, Bos taurus; identical to SEQ ID NO: 27229

SEQ ID NO: 108168 - DNA, 201 bp, Bos taurus; identical to SEQ ID NO: 27230

SEQ ID NO: 108169 - DNA, 201 bp, Bos taurus; identical to SEQ ID NO: 27231

SEQ ID NO: 108170 - DNA, 201 bp, Bos taurus; identical to SEQ ID NO: 27232

SEQ ID NO: 108171 - DNA, 201 bp, Bos taurus; identical to SEQ ID NO: 27233

SEQ ID NO: 108172 - DNA, 201 bp, Bos taurus; identical to SEQ ID NO: 27234

SEQ ID NO: 108173 - DNA, 201 bp, Bos taurus; identical to SEQ ID NO: 27235

SEQ ID NO: 108174 - DNA, 201 bp, Bos taurus; identical to SEQ ID NO: 27237

SEQ ID NO: 108175 - DNA, 201 bp, Bos taurus; identical to SEQ ID NO: 27239

SEQ ID NO: 108176 - DNA, 201 bp, Bos taurus; identical to SEQ ID NO: 27240

SEQ ID NO: 108177 - DNA, 201 bp, Bos taurus; identical to SEQ ID NO: 27241

SEQ ID NO: 108178 - DNA, 201 bp, Bos taurus; identical to SEQ ID NO: 27242

SEQ ID NO: 108179 - DNA, 201 bp, Bos taurus; identical to SEQ ID NO: 27243

SEQ ID NO: 108180 - DNA, 201 bp, Bos taurus; identical to SEQ ID NO: 27244

SEQ ID NO: 108181 - DNA, 201 bp, Bos taurus; identical to SEQ ID NO: 27245

SEQ ID NO: 108182 - DNA, 201 bp, Bos taurus; identical to SEQ ID NO: 27246

SEQ ID NO: 108183 - DNA, 201 bp, Bos taurus; identical to SEQ ID NO: 27247

SEQ ID NO: 108184 - DNA, 201 bp, Bos taurus; identical to SEQ ID NO: 27248

SEQ ID NO: 108185 - DNA, 201 bp, Bos taurus
gctggggagaggatatgactaatagtcatttgatgagtttatttattggggtcttcagccatcaggatgccgtctttgtctctggggcctcagagaattcatggcagtttttaaacttgaaagtgaaagttgctcagtcttgtctgactctttgcgaccccatggactatataatccatgggattcttcaggccagagtac

SEQ ID NO: 108186 - DNA, 201 bp, Bos taurus; identical to SEQ ID NO: 27249

SEQ ID NO: 108187 - DNA, 201 bp, Bos taurus; identical to SEQ ID NO: 27250

SEQ ID NO: 108188 - DNA, 201 bp, Bos taurus; identical to SEQ ID NO: 27251

SEQ ID NO: 108189 - DNA, 201 bp, Bos taurus
cttgaaggggttgcccagggaggtggggggaagagagggaggaagagaaagcagagtgtcagtcactgggattgggaaccaggccctggatgcgaccccctaaaggcttccactcatcttcacctttattctcagagtctcccaaaggctggtgccaaagctgacaacaggccatctgtggctgaccatcaccgctcttca

SEQ ID NO: 108190 - DNA, 201 bp, Bos taurus
aactaaagagttcacactaagactagtgcagccaaataaatagatacgtttttttttctttttaagcgagagaaaaaaatgattccagaggcctcatcgtaggctcccgccctgtgcctttacatacagtctcaggcgctggggcgtgacagcactgcttaagccctgaaaaagccaagggttcgggccacgttccttgta

SEQ ID NO: 108191 - DNA, 201 bp, Bos taurus; identical to SEQ ID NO: 27252

SEQ ID NO: 108192 - DNA, 201 bp, Bos taurus
gacattaactgtggtaacaagctattagatcatcaactctgtgcttcttccagggcgggcaaagtatctaaaataacacagttatcatgactgcctcctcaaaggtaaatacattaactctcactcccaattaacaaaggggctctttacacacttaagctaaatccctctgtgctgtataaaatacttgaggtatccaat

SEQ ID NO: 108193 - DNA, 201 bp, Bos taurus
cagggcggggctggttgcgctactggcctctggggagtggcagccacggatgagctgcacactctgcagggtaagagcagcccccacaaaccaagaataacgggggccaaatgttattggtgctgaggttaaactccttgacatagagggatacttgaactgggtctaaccagaggaatactcacatacaatgtaaaatat

SEQ ID NO: 108194 - DNA, 201 bp, Bos taurus; identical to SEQ ID NO: 27253

SEQ ID NO: 108195 - DNA, 201 bp, Bos taurus
actaatggcaccctgctcaaaggaagagtgctgtcctaacacatggaactagggggaagggggggacagagacactggttccaggagggaaagaggccaataataatggggacagagcaactaaatgataccttgggagcagcagattttcatgcagtttcaagaagcagctcgttttcctcccagggaatggccatcaga

SEQ ID NO: 108196 - DNA, 201 bp, Bos taurus; identical to SEQ ID NO: 27254

SEQ ID NO: 108197 - DNA, 201 bp, Bos taurus
acagagctggggttcggcacgtgccccatccaagagaacacggagtggcactggggagaaaattccaactgcaaagccaggcacacggagacttgaagatcggccctgacaacaactaacacaccctgtatctgcaaaatgaggatcagagcactattcatttaattcttatatgacttccaggggataatgtttatgaag

SEQ ID NO: 108198 - DNA, 201 bp, Bos taurus
tctaacagacacatcaatggcattacaaaggcagaagacatctgatactccagtttctctatttcagggtacagatgctcatatttaagggaaaaaatttgggccataccctgtggcatgggagattttagttttccaaggatccaacccatattccctgcaatggaagtgcaggataaccactgggctgccagggagtcc

SEQ ID NO: 108199 - DNA, 201 bp, Bos taurus; identical to SEQ ID NO: 27255

SEQ ID NO: 108200 - DNA, 201 bp, Bos taurus
aaccaactgttctcattggttgagggttccctttggaggcattaaatttctggcatctctgaatgtctcactcagggctacgtaagcacccctgttgtggtagagaagcctcagatagagaaggagagaggccgggcacctgaggtggggagttgtcagcacgtctgaaccctgtgcactgtagttggggtggaccaagag

SEQ ID NO: 108201 - DNA, 201 bp, Bos taurus
tccggcggcccagtggggcggagtctaactgggtcctcgcagctagttgggacgtggtgggggtctgtccagaggaccttcccacgtcaccgagcctttacatggcttgttcctgagcattggccctaatcctaacctgctcctcttctgctgtattttataaatgggtaaactgaggcatggggtcacgccagcggttcc

SEQ ID NO: 108202 - DNA, 201 bp, Bos taurus
gaaaatttgttgaatggaatttgcccgactggcagaatagtttaaatgtcagatgttgttaggctgggatataaatattatgtttctattgttaattaattgcagcgcctcagtaccagtgatccaaaattcaatttagtctgcaataggcctgtggataagggccagagataatgaatgcagagggaaaaaatgtactca

SEQ ID NO: 108203 - DNA, 201 bp, Bos taurus
caggatccttgcggttttcactttttatccaaagcctcctgctaagggcacaaaagcctcagtttagaatatatacttcctagcttcggaggtcaggggcagcggccgggaggagataccccacgccccaagccagaggccaggggaggcaggccggaggagataccccacgcctctaagcccgaggccaggagcgacggg

SEQ ID NO: 108204 - DNA, 201 bp, Bos taurus; identical to SEQ ID NO: 27256

SEQ ID NO: 108205 - DNA, 201 bp, Bos taurus; identical to SEQ ID NO: 27257

SEQ ID NO: 108206 - DNA, 201 bp, Bos taurus; identical to SEQ ID NO: 27258

SEQ ID NO: 108207 - DNA, 201 bp, Bos taurus; identical to SEQ ID NO: 27259

SEQ ID NO: 108208 - DNA, 201 bp, Bos taurus
ataaattattaaaccactctgtgcctcattttcctcatctgtaaaaatgaggattatgacagtattcatgttcaccttgcagaactgttgtgaagatgaacagattccatgtaatacccttggcaacatacgggtggtgctcctttgtcctattcttggaaacttgcacaccaagctaaagtcatttttattatttgtttt

SEQ ID NO: 108209 - DNA, 201 bp, Bos taurus; identical to SEQ ID NO: 27260

SEQ ID NO: 108210 - DNA, 201 bp, Bos taurus; identical to SEQ ID NO: 27261

SEQ ID NO: 108211 - DNA, 201 bp, Bos taurus
agtctggaaagttgatgtcctcctcctcctcttggcctctcctcagttctcccagttactttcagtggcagcaccctgttccttaccaggatctcctgctattagacacctcaggcaagtgggcctggccaaggtgggtggtttctatcaatagttccctaacacagccgccctccacctcccatggttcaggcagtaatg

SEQ ID NO: 108212 - DNA, 201 bp, Bos taurus
aagctccaggagatagtgatggacagggaggcctggcgtgctgcagtccacggggttgcaaagagtcagacataactgagtgaacagcaacacagattttcccaagggcatcacctcctatagtaagagagagagacccggtgtcgttctctttagagacaaaggggaaaggaaacgttcctttcaggaaacctgatcatg

SEQ ID NO: 108213 - DNA, 201 bp, Bos taurus
atctatatagaatacagatgcaaatttaggctcagaggggttagagaacttgctcaaggtcacaaagttaatagtaggtggatttgggatccactcaggcttgattcccaaaacctatgtatgctctgtggagaaaaactgaaaaccaaggacttgcagcaaatgtaataaataccacttccaatttctttcctgtattgg

SEQ ID NO: 108214 - DNA, 201 bp, Bos taurus; identical to SEQ ID NO: 27262

SEQ ID NO: 108215 - DNA, 201 bp, Bos taurus
tggacagctttggaatacactcagggtcctccctagggggggcacgccttttctcccctgtgtcctcactccaggcccagtgagattgtgtgaagaagcctgggcttgtggacaggggagggcagagtccgcggaggacactcccgcggctggccggctgctcaggggaaaggttcagacgctttttgaccgggcactgtt

SEQ ID NO: 108216 - DNA, 201 bp, Bos taurus
gaaatccagcactccggccgaggcatctcggcagcactgcatggttcttaattgtactttcttttcacaatgtgtaaagatgtttgttttcagatcctcaactctcaaggcaaaacagaacttcaaagatttcaaacttcaaagaacacaagaaaattaacgtgatatttgggagctgtaacctgtgtttcctcttgccaa

SEQ ID NO: 108217 - DNA, 201 bp, Bos taurus
cctccaaaaatttttcatccacgcctatagtctctctgcactctctgtccttgtgaaagaaaaacttaattttattctttttttgccattttctaagaagcgttgaagagagagagcatttttactcttcaagtggtggcacgcgccactgaggcctcccccactgctctggtccattgtccctttctttctcaggtccca

SEQ ID NO: 108218 - DNA, 201 bp, Bos taurus; identical to SEQ ID NO: 27263

SEQ ID NO: 108219 - DNA, 201 bp, Bos taurus; identical to SEQ ID NO: 27264

SEQ ID NO: 108220 - DNA, 201 bp, Bos taurus; identical to SEQ ID NO: 27265

SEQ ID NO: 108221 - DNA, 201 bp, Bos taurus; identical to SEQ ID NO: 27267

SEQ ID NO: 108222 - DNA, 201 bp, Bos taurus
gaatgacaacacaggctagaaaacacgtccacgtttcaagtgagccgattgtgaaactaggagaatgcctctgttatctgtaaacacccacactggcctttggtatctacatatgctctttattttcacactcatacactgactccctgagacgagatctacccagcacagaccccgccaggcacagcactgcatgccagg

SEQ ID NO: 108223 - DNA, 201 bp, Bos taurus
cctgaggaaagcatttgcctgatcagtatctatcattttggagctcctgagaggtgctggcaaagccaggccactcagttgggccttgtctgcgtgctcacctctgtgacccaggacttattagcacagtgccaagcatacttcaggctctggataaatgcatcgaaagtaactgaatgaataaactccctgtgggtggct

SEQ ID NO: 108224 - DNA, 201 bp, Bos taurus; identical to SEQ ID NO: 27268

SEQ ID NO: 108225 - DNA, 201 bp, Bos taurus
gttgtcatgtccattttatagaggaggaaactcaggcccagacaagttaaacaacttgcccattgtcgcacagctggtgagtaatggaggtagtgcctctcgcatgagacagtaggctcagggcccagggccacaatacctttagaagccacaggaatgttgtaatttgtttcagaataaggaggaaaagaaattcaaaat

SEQ ID NO: 108226 - DNA, 201 bp, Bos taurus; identical to SEQ ID NO: 27269

SEQ ID NO: 108227 - DNA, 201 bp, Bos taurus; identical to SEQ ID NO: 27270

SEQ ID NO: 108228 - DNA, 201 bp, Bos taurus
aaaattttatggggcattcattctctgtataatatagtttctttatcatttatttaaagttgatttttcatattctacctttccagtcaggaggataatatatgtaattctgtatatcccattatctgatgatgtatgtcacttggtctccttcaatttacacttttacaatatttgaaataatttctctattcttctccc

SEQ ID NO: 108229 - DNA, 201 bp, Bos taurus
gtgccaaaagaaataacattttaaatgatgaagaaatttgtcttaatttccttaaagttggaataaaagatatgtaaattttcaaagaagcctgtaagaattgatgttgctgaaataatactgtactaacacttagtctcagttttcctcttagctttctacagtattttctaaagtgtcctacacagcaagatggggaag

SEQ ID NO: 108230 - DNA, 201 bp, Bos taurus; identical to SEQ ID NO: 27271

SEQ ID NO: 108231 - DNA, 201 bp, Bos taurus; identical to SEQ ID NO: 27272

SEQ ID NO: 108232 - DNA, 201 bp, Bos taurus; identical to SEQ ID NO: 27274

SEQ ID NO: 108233 - DNA, 201 bp, Bos taurus; identical to SEQ ID NO: 27275

SEQ ID NO: 108234 - DNA, 201 bp, Bos taurus; identical to SEQ ID NO: 27276

SEQ ID NO: 108235 - DNA, 201 bp, Bos taurus; identical to SEQ ID NO: 27277

SEQ ID NO: 108236 - DNA, 201 bp, Bos taurus
tgtaccctctgtgtgttctgtcctcaccgacctccctgtaatgtcctctgcctggaaaaaccttccttcaatctgcctgtccatctctctttaagtccttcaagttttagcttaagagttacttcctctataagccctttctgaatttcccagatgcacttagatgtttctttcttaatgttctctttgttctttgtacac

SEQ ID NO: 108237 - DNA, 201 bp, Bos taurus
gacacagggatgagaatttggagatggtcttaatagggaaaatttccacagtagttgtaagtattgtcatacacaattatggaacacagtctcctacttgttctaatcgagtatttagttatctgtggacagaaaaataaaatctgagagaatatgacctgattactatatttccctggtaatttcttcagttaagaagat

SEQ ID NO: 108238 - DNA, 201 bp, Bos taurus
gtctggacttggggttattttgatggatcataatgcctttgaggttcatccgtgctttggtgggtgttagtctgttgaaaatcaatagtgttccattgcatggatgaactgcagtcatttgcccgttcacctgttgaagttgtccagtcactatcacagtggataccccttcagagggatcttgcctgaatgactgtgggg

SEQ ID NO: 108239 - DNA, 201 bp, Bos taurus; identical to SEQ ID NO: 27278

SEQ ID NO: 108240 - DNA, 201 bp, Bos taurus
caccttctcctagtgaagaagaggttgtcatcttaagaattttatttggtgatgctgggatccagttttggttgaatagtggatggcagcaggcacatagtttcttctttcaacttgcattagggaagcaggagagcaagccaggttgatggtgggagggagggggcaggaagagagctagttggaggaggcctttgaact

SEQ ID NO: 108241 - DNA, 201 bp, Bos taurus; identical to SEQ ID NO: 27279

SEQ ID NO: 108242 - DNA, 201 bp, Bos taurus; identical to SEQ ID NO: 27280

SEQ ID NO: 108243 - DNA, 201 bp, Bos taurus
tgatgtcggaaactgggaaggcccttttgggagcttgctttctcagaataagtcctcaggaccatggaaaacatttgggcctttctttctgtgaaaacagcgttgcttcacccttacatgatggatttagccctcagcccttgtagggttacaagagaatcagggcaaccttcagggctggcctcctggggccccggctcc

SEQ ID NO: 108244 - DNA, 201 bp, Bos taurus; identical to SEQ ID NO: 27281

SEQ ID NO: 108245 - DNA, 201 bp, Bos taurus
cattctgttttgtaaattagtgaatggaggagaggatgaagtgaactgcctaaattcatccagtgagtatgtggcagggccaaaatttgaacttggactacctggttcccacacatatatatttaactactgtatgaagtttggccagtgagagaaaggaagaaagatctctggggggcaggctgagataggcagcacacg

SEQ ID NO: 108246 - DNA, 201 bp, Bos taurus
tctcctcctgtcctcaatctttcccagaatcagggtcttttcaaaatcctgttggacgctgattattcatcaggcctcgagccaggcccaggtgagcctttggaaagcactcagtcagaagctgtgtgtgaaggatcaccttctgccctccaattgcaggtcacaattcaccaggccagttaggagaacagggaaaagtca

SEQ ID NO: 108247 - DNA, 201 bp, Bos taurus
ttggaaccaaggactggggtaaaggcataggcctctagggttccaggtcccaaggtcaacgtgatgtgctatactttctgatgtcagaaagggccttctagaataagatacacattgctactatcctgtctgctgtttcaccccaatgcaactgcccccagaacctcaggccatgttcctatttggaaatagggtctttgt

SEQ ID NO: 108248 - DNA, 201 bp, Bos taurus
cgggaaaagagctaccacaatctacaacagctacaaagctattttataaactagaagcttcgagagtcccatctcttgctcctgatgtcagagggccaaatgttcattcctagatcaagattactttcactggattgttttttgaagggctagttccccttgaaagtatatttttttgttgttgtttttaatgagaagagt

SEQ ID NO: 108249 - DNA, 201 bp, Bos taurus
aaatagtatcttttccatgtaagttagccagggtatgtctctgctgctggcagatgccatgagaacatggcagcctcgggggcattccctccctcgcccactgaggaaactccaccatgtagagagcacagtgctcagggcaagggagggcaccaggcaggccaaatcagtaaggcccctgccctcagagaagtccacatg

SEQ ID NO: 108250 - DNA, 201 bp, Bos taurus
gctaagagcccaaaacaaaagctaaaattaatgttaaaggtgaagaaaatctcagaagcagtcccatccagtcgatcacaaacttgaaaaagaaaatcttcgtctccttatagggctttcttatcctctttcctctgaacaatctttcttttgcctccagccaagaatttttttattaatccaaaacaaaactgtaatatt

SEQ ID NO: 108251 - DNA, 201 bp, Bos taurus
ggccagaacatcaaaatagaatgagaggatgagctacccagcagggaaaagaaaaagccaaaatgagcacgacctgtcctgcagggagcttcacccgagtcccaatgggccccctccttgctgtgatgcccggctatcatcatcttgaaattcttcataactttttaacaaatggaactacattttgctttcccactgggt

SEQ ID NO: 108252 - DNA, 201 bp, Bos taurus
tttgagtaagctccaggagttggtgatggacagggaggcctggcctgctgcagttcatggggtcgcaaagagtcggacacgactgagtgactaaactgaattaaggagtaaaaacaggccccataaaaagggtctggagtccaaatggtcttcaacttcttaacaacaactatggaagctggaagacaagttttctgaaga

SEQ ID NO: 108253 - DNA, 201 bp, Bos taurus; identical to SEQ ID NO: 27282

SEQ ID NO: 108254 - DNA, 201 bp, Bos taurus; identical to SEQ ID NO: 27283

SEQ ID NO: 108255 - DNA, 201 bp, Bos taurus
acaaattacggagcacaaagagaaacagcaccaggcctcccacctcactccgcatgaaattaatgaccccactgagaggtctctgcttactcagagtcacgtcaagccaacctgagggggaggagacctttgtgactaagtacgatctgactaagtgctcctaccatgtcgctgagagaccacccctcctgagggacaccc

SEQ ID NO: 108256 - DNA, 201 bp, Bos taurus
tttattttgtttggaactttaccaagaaatgctcaccattttggaaaatcacatcgctgacagcgatgccacgagttgtatttgatggccaataaaaatgataaatgaacgccaacaccacatactcctggttgtagcatttgtagctgtcacatttatagtgatgctatgtatagctgcaaatatctgatgactttacat

SEQ ID NO: 108257 - DNA, 201 bp, Bos taurus
gtccatttatggttgtgggacagtacctaagatgtctgggagtcttgctgctgacagttgctagcagatcagactgcctcctggcccaaggtgtgaaacacggattgtgactccacactgggtctctgttgggcttcccttctcctgatcctttggccacagaaggcaggcttttcttggttcttctgtctatggctgctg

SEQ ID NO: 108258 - DNA, 201 bp, Bos taurus; identical to SEQ ID NO: 27284

SEQ ID NO: 108259 - DNA, 201 bp, Bos taurus
tgtggccctgggtgtgaggtgcgattctcatcagggctctgagggaagtgtcttagcaaagcctcctctcagggcctcatgggccatttccctaccgctccccacccccctggaaactatctttgtggtcttcccccaacctcactaagtctgcttctctttacaggtggccctgttgaatcccattgaaaacccagactt

SEQ ID NO: 108260 - DNA, 201 bp, Bos taurus; identical to SEQ ID NO: 27285

SEQ ID NO: 108261 - DNA, 201 bp, Bos taurus; identical to SEQ ID NO: 27286

SEQ ID NO: 108262 - DNA, 201 bp, Bos taurus; identical to SEQ ID NO: 27287

SEQ ID NO: 108263 - DNA, 201 bp, Bos taurus
aggacccccagttcacccaagcccagcagctctgggcagccccagatgtggtccctcccttgggggcagccgagtcaggtggccaagctgtgcattaaataagccagatgaaggagcatgccagtgggcgggggcgtgaggagcagggctgggcacccccataccatagcactgggacccccagtagcccgggcagcaggc

SEQ ID NO: 108264 - DNA, 201 bp, Bos taurus; identical to SEQ ID NO: 27288

SEQ ID NO: 108265 - DNA, 201 bp, Bos taurus
atgcatgcactcagccagagtcctggtggcctctaggctccttcatgtctctataagtcatctatcctggttagtgacatgtgaccaacatctgacctgttcctagcctgtgtggccaggcctggaacagggaggatgggaggttgaacacacagcattcactcattagcactctgtggagtaggcagcatcacacccatt

SEQ ID NO: 108266 - DNA, 201 bp, Bos taurus
tgatacgtccctcccttgtcctcaggaggagtgctggcatctccatgactacctactgggcaccctgggtccctatgtgatcaacgtgaccagggcagccatggcctgcagtcaccagcggtgccatggccatggccgttgtgcttggcaaaacccaggacaactagaagtctttctgcatctgcagccagatggcagccc

SEQ ID NO: 108267 - DNA, 201 bp, Bos taurus; identical to SEQ ID NO: 27294

SEQ ID NO: 108268 - DNA, 201 bp, Bos taurus; identical to SEQ ID NO: 27295

SEQ ID NO: 108269 - DNA, 201 bp, Bos taurus; identical to SEQ ID NO: 27296

SEQ ID NO: 108270 - DNA, 201 bp, Bos taurus; identical to SEQ ID NO: 27298

SEQ ID NO: 108271 - DNA, 201 bp, Bos taurus; identical to SEQ ID NO: 27300

SEQ ID NO: 108272 - DNA, 201 bp, Bos taurus; identical to SEQ ID NO: 27301

SEQ ID NO: 108273 - DNA, 201 bp, Bos taurus; identical to SEQ ID NO: 27303

SEQ ID NO: 108274 - DNA, 201 bp, Bos taurus; identical to SEQ ID NO: 27307

SEQ ID NO: 108275 - DNA, 201 bp, Bos taurus; identical to SEQ ID NO: 27310

SEQ ID NO: 108276 - DNA, 201 bp, Bos taurus; identical to SEQ ID NO: 27317

SEQ ID NO: 108277 - DNA, 201 bp, Bos taurus; identical to SEQ ID NO: 27320

SEQ ID NO: 108278 - DNA, 201 bp, Bos taurus; identical to SEQ ID NO: 27321

SEQ ID NO: 108279 - DNA, 201 bp, Bos taurus; identical to SEQ ID NO: 27322

SEQ ID NO: 108280 - DNA, 201 bp, Bos taurus
cttgctttcacataattccactttctctttcatgttccttgagtcatgaactttccttgaaattttttatcctattcttcgagaaataggcattcttttcgacatgaattcttcgcttttgtgctccagcttcctgttttgctctatttcctgcctcctcctcttagcagggactttgaccctcaagaagcccctgctcct

SEQ ID NO: 108281 - DNA, 201 bp, Bos taurus; identical to SEQ ID NO: 27325

SEQ ID NO: 108282 - DNA, 201 bp, Bos taurus; identical to SEQ ID NO: 27326

SEQ ID NO: 108283 - DNA, 201 bp, Bos taurus; identical to SEQ ID NO: 27327

SEQ ID NO: 108284 - DNA, 201 bp, Bos taurus
gttaccaggggaggagccctgcgaggggtggatggtgggagggaaccacgggttagatacaagtcattgtcaaagtcttagtttttggttggtgagttcatgggttcactattaaaattaactacttaaaaaaaataactaagtgacagttgcacagcaacatagatgccactgcacttaaaatggttaaaatggcaaatt

SEQ ID NO: 108285 - DNA, 201 bp, Bos taurus
gaaaatgttctaaaattgattaatgatgatggttgtatcactatgtaaatttactaaaaatcactgaagtatattcctgcaataaataaatctcaggatatgtaaaatataccaccaacaaagttgtttataagggaaaagaacatactatgatagctgcgaagctggcctgaaagatgctttcaacaactgactctagat

SEQ ID NO: 108286 - DNA, 201 bp, Bos taurus; identical to SEQ ID NO: 27329

SEQ ID NO: 108287 - DNA, 201 bp, Bos taurus; identical to SEQ ID NO: 27332

SEQ ID NO: 108288 - DNA, 201 bp, Bos taurus; identical to SEQ ID NO: 27334

SEQ ID NO: 108289 - DNA, 201 bp, Bos taurus; identical to SEQ ID NO: 27335

SEQ ID NO: 108290 - DNA, 201 bp, Bos taurus; identical to SEQ ID NO: 27336

SEQ ID NO: 108291 - DNA, 201 bp, Bos taurus; identical to SEQ ID NO: 27337

SEQ ID NO: 108292 - DNA, 201 bp, Bos taurus; identical to SEQ ID NO: 27338

SEQ ID NO: 108293 - DNA, 201 bp, Bos taurus; identical to SEQ ID NO: 27340

SEQ ID NO: 108294 - DNA, 201 bp, Bos taurus; identical to SEQ ID NO: 27342

SEQ ID NO: 108295 - DNA, 201 bp, Bos taurus; identical to SEQ ID NO: 27347

SEQ ID NO: 108296 - DNA, 201 bp, Bos taurus; identical to SEQ ID NO: 27351

SEQ ID NO: 108297 - DNA, 201 bp, Bos taurus; identical to SEQ ID NO: 27352

SEQ ID NO: 108298 - DNA, 201 bp, Bos taurus; identical to SEQ ID NO: 27354

SEQ ID NO: 108299 - DNA, 201 bp, Bos taurus; identical to SEQ ID NO: 27356

SEQ ID NO: 108300 - DNA, 201 bp, Bos taurus; identical to SEQ ID NO: 27358

SEQ ID NO: 108301 - DNA, 201 bp, Bos taurus
aacacagaatgtaaagggaggcgtcctgactcacactcagtttggctttatcacagcacgtaagccgcatccaggcctttccccttaatctcacgacggtactttccctaaaaagatcatgccgcgtgattttcccccgaatgcttcaccccagctgtgcaggcctctttcctgtttatcacggctgcactgaactttatt

SEQ ID NO: 108302 - DNA, 201 bp, Bos taurus
tccacaggctgcacagtccgttggatcgcaaagagtcggacacgaccgagtgactttcactttcacacagaagtccagctgtgagccccaaactgagacgaacaaatcacgggaggaaggacacagtgtccagcctgggctgcaaagataactgcaggagaggggaagggccccaagggagactagggacggcgacccccg

SEQ ID NO: 108303 - DNA, 201 bp, Bos taurus
aatgaggcccatcagagctttcaaacgggctcagctgaattcccttttctgccaggaaagggacacaggctaccttccccaagcacaccccactctccgcagatggccacgtgctcacacaccaggaagctctccgcagcctttccttgtggctttcttgggggcccggttgagcaagtgacagcccacgtggaactgatg

SEQ ID NO: 108304 - DNA, 201 bp, Bos taurus; identical to SEQ ID NO: 27359

SEQ ID NO: 108305 - DNA, 201 bp, Bos taurus; identical to SEQ ID NO: 27360

SEQ ID NO: 108306 - DNA, 201 bp, Bos taurus
ctacaaccagactctttgcttcacaacagcctcactttttacttcactgtgacctgactctatgaccttagctcactaggccccagatctgttcctcattgggctcggacgtgagtccacactacggactgactggtttttcacttctgcctgacactggtcctcaatagggcccgattctcatcctcacttgtgcctgaa

SEQ ID NO: 108307 - DNA, 201 bp, Bos taurus
catgaaggctgggagaaaccttcattcacactggcccacagctctgttcccatgactccagctctacttcccaccaaggcagtgcctgtcagtacatcctagaagaacaagtggcctacgatcacctcagatccagctctcccaccaaagccatggggcacagcagaatgcattgggacactcccccacaaaagatgtacc

SEQ ID NO: 108308 - DNA, 201 bp, Bos taurus
attcaatgatgagcttgttaaaaattcatctccttacttgctatttgacttccctcatcctacgagaggacttccatggtggttcagctgtaaagtacatttttccaatgagggagacaccagactgatccttgagtctggaagatctcctgaagaaataaatggcaacccactccagtattcttgcctaggaaatctcat

SEQ ID NO: 108309 - DNA, 201 bp, Bos taurus; identical to SEQ ID NO: 27361

SEQ ID NO: 108310 - DNA, 201 bp, Bos taurus; identical to SEQ ID NO: 27362

SEQ ID NO: 108311 - DNA, 201 bp, Bos taurus
tgtcattgctgtgaaggctttaggccccacatcaggcttcccagcccagggatccggcaaaagactgggaatccccagtgagcctgactgtgaaggccaacgtgatttgattacatgacctccacaggactaggggaaacagaaactccactctaggagggcacaaacagacctgctgtgcaccaggacccaggggaaagg

SEQ ID NO: 108312 - DNA, 201 bp, Bos taurus
ataaagttagaaaaatgaataataatttaatatcctgtcattctaattagtatgttgatgtctcagtaactttgctaacatgatccatgtaaaaatcaattatctggttatttcattaatgcccttttctttaatagcataggcacatctggaatacactaaaatttataccaaaaaggaaagattaatcacttacactta

SEQ ID NO: 108313 - DNA, 201 bp, Bos taurus
gacatcatacagtggcattgtataggggcccgacagcgtacttccctctggtcaccagagctatatgctctgtggctgcccctactgagccctgttgtagtagggccaactatgtgagagagctggtaaggggctggcctctggcccagtaagctgtgagatcatgtcttgtgctgtcctggaaggtggggtgctggtgcc

SEQ ID NO: 108314 - DNA, 201 bp, Bos taurus; identical to SEQ ID NO: 27363

SEQ ID NO: 108315 - DNA, 201 bp, Bos taurus
acaacagtcctgacttcctgctgagaaaatattctgaggaaggagaaaagtagcattttggatgtcatgacacctctgccagcactttggtaagtcctccagcatacactctgaggccacttgaccttgtctgtctggcgaaccttatgttccctttggaggatttttttcatcctgtttgtaaggtgccacttggactaa

SEQ ID NO: 108316 - DNA, 201 bp, Bos taurus
ggcagatgctttaacccctgagccaccagggaagccaccttattgagctataattgacaaataaaaattgtgtacatttaggtgttcaacacgatgttttaatattattaaacattgtgaaaagattcccacaaactaattaacacatgtgtgtggtgagaacacttaagatccactcttagcaaatttcaagtatgcaaa

SEQ ID NO: 108317 - DNA, 201 bp, Bos taurus; identical to SEQ ID NO: 27364

SEQ ID NO: 108318 - DNA, 201 bp, Bos taurus; identical to SEQ ID NO: 27365

SEQ ID NO: 108319 - DNA, 201 bp, Bos taurus; identical to SEQ ID NO: 27366

SEQ ID NO: 108320 - DNA, 201 bp, Bos taurus; identical to SEQ ID NO: 27367

SEQ ID NO: 108321 - DNA, 201 bp, Bos taurus; identical to SEQ ID NO: 27368

SEQ ID NO: 108322 - DNA, 201 bp, Bos taurus; identical to SEQ ID NO: 27369

SEQ ID NO: 108323 - DNA, 201 bp, Bos taurus; identical to SEQ ID NO: 27370

SEQ ID NO: 108324 - DNA, 201 bp, Bos taurus; identical to SEQ ID NO: 27371

SEQ ID NO: 108325 - DNA, 201 bp, Bos taurus; identical to SEQ ID NO: 27373

SEQ ID NO: 108326 - DNA, 201 bp, Bos taurus; identical to SEQ ID NO: 27374

SEQ ID NO: 108327 - DNA, 201 bp, Bos taurus; identical to SEQ ID NO: 27375

SEQ ID NO: 108328 - DNA, 201 bp, Bos taurus; identical to SEQ ID NO: 27376

SEQ ID NO: 108329 - DNA, 201 bp, Bos taurus
tttaggtagagatgaggaagggaaaaaaacaatgtttattatggaattcattgtcttgtctaacgacttgttaaatagtaagagatgacttctaaagaaataaggacagtgtagggaaattaacaagatagtgcccgtcaggctctcaccccagctctcatgccctcttgccccatattgtgtaaaaaatgactttgcatg

SEQ ID NO: 108330 - DNA, 201 bp, Bos taurus; identical to SEQ ID NO: 27377

SEQ ID NO: 108331 - DNA, 201 bp, Bos taurus
ttacataagcaaagtcaagggtcacccaaggcctaggtcgcaaccacctggctccagtgctgccctgcaggacggaccacttacaggcttaggtaccacagggccagaagaacttcagcccctgaagggcacctcagggcacagttagtactgtcataaatcaagagccagctcgggtcagagaagaaggggctttctccc

SEQ ID NO: 108332 - DNA, 201 bp, Bos taurus
gctgtaggattcacttctaagatcatgcttgtggttgttgttagcagaccacgtttcctctatggctgttggctggatatttcagtttcttaacacatgagtttctctcaacaaagcagcttactttacccagagcaagaaatccaagagcaagaaagtgaatgcccaagatgaagctatgatcttttataatgtaatctt

SEQ ID NO: 108333 - DNA, 201 bp, Bos taurus; identical to SEQ ID NO: 27378

SEQ ID NO: 108334 - DNA, 201 bp, Bos taurus; identical to SEQ ID NO: 27379

SEQ ID NO: 108335 - DNA, 201 bp, Bos taurus; identical to SEQ ID NO: 27380

SEQ ID NO: 108336 - DNA, 201 bp, Bos taurus; identical to SEQ ID NO: 27381

SEQ ID NO: 108337 - DNA, 201 bp, Bos taurus; identical to SEQ ID NO: 27382

SEQ ID NO: 108338 - DNA, 201 bp, Bos taurus; identical to SEQ ID NO: 27383

SEQ ID NO: 108339 - DNA, 201 bp, Bos taurus; identical to SEQ ID NO: 27384

SEQ ID NO: 108340 - DNA, 201 bp, Bos taurus; identical to SEQ ID NO: 27385

SEQ ID NO: 108341 - DNA, 201 bp, Bos taurus
gtgataattttaaagagccatcctggttctagaacttgttatggggcagcctgaggtccctgctgtaactgcatcacagcccacttctctggcaacccaggcccacctccttctttctccttgacagtgctgtcaactgaacacacttcccagtaactttctatagtgacacctcagtcttagactccatttctgggggaa

SEQ ID NO: 108342 - DNA, 201 bp, Bos taurus; identical to SEQ ID NO: 27386

SEQ ID NO: 108343 - DNA, 201 bp, Bos taurus; identical to SEQ ID NO: 27387

SEQ ID NO: 108344 - DNA, 201 bp, Bos taurus; identical to SEQ ID NO: 27390

SEQ ID NO: 108345 - DNA, 201 bp, Bos taurus; identical to SEQ ID NO: 27391

SEQ ID NO: 108346 - DNA, 201 bp, Bos taurus; identical to SEQ ID NO: 27395

SEQ ID NO: 108347 - DNA, 201 bp, Bos taurus; identical to SEQ ID NO: 27396

SEQ ID NO: 108348 - DNA, 201 bp, Bos taurus; identical to SEQ ID NO: 27400

SEQ ID NO: 108349 - DNA, 201 bp, Bos taurus; identical to SEQ ID NO: 27401

SEQ ID NO: 108350 - DNA, 201 bp, Bos taurus
acacatcccgagctgtgttctccccagtggccagccccgaagagacaagtttgccatcaatgtccacttcctgcttccctaggagtcaccatcagtggccgagacaccctgtccaacttcacccggctctttctctccttcctatggcaggtgctcagcacctctgggagcctctgtggccttgagggaggcagaaatggg

SEQ ID NO: 108351 - DNA, 201 bp, Bos taurus
ttggaagagggtcaggccaggacctgaggatggggccttcggaaccaacagaaggatttcgatttgatggggaggaaattgggggccccttgttgtcttgaagggcagatgacaagcgtgtggtggttgaggagcactcagtgttggggtgtaggcgctggagtggggagaggcaggactgggaggccaatggcgaggtgg

SEQ ID NO: 108352 - DNA, 201 bp, Bos taurus
ggtaaaatttaatttcctgcaaaattttcagtgcacattaagctatataatcttctgccttgggtactccacataagtgtttaactttcttgttttatgacctggaatttttgactcaccttgaagatgccactagggcaagagatcactgagatacctgagaaagaaaaacttaaggaatcagcatttaccaagcgaatt

SEQ ID NO: 108353 - DNA, 201 bp, Bos taurus; identical to SEQ ID NO: 27402

SEQ ID NO: 108354 - DNA, 201 bp, Bos taurus; identical to SEQ ID NO: 27403

SEQ ID NO: 108355 - DNA, 201 bp, Bos taurus
tagcaagatatgggctgccgaagcctggagcgaggggcgcaaaaaggaactcctggaggaattaaagttgggcagaaagtgccacaggggtcaggacctgcgggcctacaggtgggagtattcccacaggggatatttttggacatagagtagggtgagagacttggcagcagaagaacccagagttccttcccctgtctg

SEQ ID NO: 108356 - DNA, 201 bp, Bos taurus; identical to SEQ ID NO: 27404

SEQ ID NO: 108357 - DNA, 201 bp, Bos taurus; identical to SEQ ID NO: 27405

SEQ ID NO: 108358 - DNA, 201 bp, Bos taurus; identical to SEQ ID NO: 27406

SEQ ID NO: 108359 - DNA, 201 bp, Bos taurus; identical to SEQ ID NO: 27407

SEQ ID NO: 108360 - DNA, 201 bp, Bos taurus; identical to SEQ ID NO: 27408

SEQ ID NO: 108361 - DNA, 201 bp, Bos taurus; identical to SEQ ID NO: 27409

SEQ ID NO: 108362 - DNA, 201 bp, Bos taurus; identical to SEQ ID NO: 27410

SEQ ID NO: 108363 - DNA, 201 bp, Bos taurus; identical to SEQ ID NO: 27413

SEQ ID NO: 108364 - DNA, 201 bp, Bos taurus; identical to SEQ ID NO: 27414

SEQ ID NO: 108365 - DNA, 201 bp, Bos taurus; identical to SEQ ID NO: 27415

SEQ ID NO: 108366 - DNA, 201 bp, Bos taurus; identical to SEQ ID NO: 27417

SEQ ID NO: 108367 - DNA, 201 bp, Bos taurus; identical to SEQ ID NO: 27421

SEQ ID NO: 108368 - DNA, 201 bp, Bos taurus; identical to SEQ ID NO: 27423

SEQ ID NO: 108369 - DNA, 201 bp, Bos taurus; identical to SEQ ID NO: 27424

SEQ ID NO: 108370 - DNA, 201 bp, Bos taurus
gaagcccactcttgctgagtgacctgtgtccaccacatcatcttttcaaatgtattcaccagaaatatggaaagtcacataagccttgtaaaggccgatacagtgggacttccctggcagtgtagtggttaagacttcaccttccaatgcaggggctgctggttcaatccctgatcggggggatgtaaaatcccacatccc

SEQ ID NO: 108371 - DNA, 201 bp, Bos taurus; identical to SEQ ID NO: 27425

SEQ ID NO: 108372 - DNA, 201 bp, Bos taurus; identical to SEQ ID NO: 27426

SEQ ID NO: 108373 - DNA, 201 bp, Bos taurus; identical to SEQ ID NO: 27427

SEQ ID NO: 108374 - DNA, 201 bp, Bos taurus
gatgcagatacatccaatctggatacccctgggcacctcgatatacaaagacatctattctcacccatctctttcactcactatgcccatgctcaggccagccaagaccccacacagacatgcagatacacacagccctgcggtatgagcttggatatgttggtgaatgaagctgaccaagatccctgccctcagggaggt

SEQ ID NO: 108375 - DNA, 201 bp, Bos taurus; identical to SEQ ID NO: 27429

SEQ ID NO: 108376 - DNA, 201 bp, Bos taurus
tttttgacatctcagttgattttgaccatttgggccgcttgtttttcctcttcctgtgctttagattcctgctcttaagctttaaattcaccaatagtgtgcctgcacaaccctaggcccccaccctcaaccccaaaagaagccaaacctcaggccccacgtgtgttctccacccctgcccctcccatgacctcactgtgt

SEQ ID NO: 108377 - DNA, 201 bp, Bos taurus; identical to SEQ ID NO: 27432

SEQ ID NO: 108378 - DNA, 201 bp, Bos taurus
agggcatgtgggagacaacctctaggagcctaactggtgagagctggtcaccaccacccctgcccctcatgtgatacaaggaagaggcacttagatagagcgggctccctgttgttctggtctatatggctttgaggcgcttggtcttcagtaaaggagctctagttttcgtcccttccagtaagtggtgatgcacttctc

SEQ ID NO: 108379 - DNA, 201 bp, Bos taurus
acaaatagggacgggggagaccgcagcccaactcgccgcgctttggatgaggaggggactcggtttgctggggtcgcatctcggaggttccggggccagtagtctcctttccttcatccctgggtcggctgggtcatacgagaggaaaacttcttggggacttgagagcgtctagaaacggcctcctgtgattttgtgcgc

SEQ ID NO: 108380 - DNA, 201 bp, Bos taurus; identical to SEQ ID NO: 27433

SEQ ID NO: 108381 - DNA, 201 bp, Bos taurus; identical to SEQ ID NO: 27434

SEQ ID NO: 108382 - DNA, 201 bp, Bos taurus; identical to SEQ ID NO: 27439

SEQ ID NO: 108383 - DNA, 201 bp, Bos taurus; identical to SEQ ID NO: 27442

SEQ ID NO: 108384 - DNA, 201 bp, Bos taurus; identical to SEQ ID NO: 27443

SEQ ID NO: 108385 - DNA, 201 bp, Bos taurus; identical to SEQ ID NO: 27444

SEQ ID NO: 108386 - DNA, 201 bp, Bos taurus; identical to SEQ ID NO: 27445

SEQ ID NO: 108387 - DNA, 201 bp, Bos taurus; identical to SEQ ID NO: 27446

SEQ ID NO: 108388 - DNA, 201 bp, Bos taurus; identical to SEQ ID NO: 27447

SEQ ID NO: 108389 - DNA, 201 bp, Bos taurus; identical to SEQ ID NO: 27449

SEQ ID NO: 108390 - DNA, 201 bp, Bos taurus; identical to SEQ ID NO: 27450

SEQ ID NO: 108391 - DNA, 201 bp, Bos taurus; identical to SEQ ID NO: 27452

SEQ ID NO: 108392 - DNA, 201 bp, Bos taurus; identical to SEQ ID NO: 27453

SEQ ID NO: 108393 - DNA, 201 bp, Bos taurus; identical to SEQ ID NO: 27455

SEQ ID NO: 108394 - DNA, 201 bp, Bos taurus
aggctctctgctcagggccacacagtaagcagccaaggggccaaatagagaattccaaccaggatgtctgacttggagactgggcttgcttccttctcgtgtgcctccgttaacaaaggagacctctctataagtcaaaacagcgtcatcctgtctgggaaaaatgaaactgtgtggaataaaggccaacactgcataacg

SEQ ID NO: 108395 - DNA, 201 bp, Bos taurus; identical to SEQ ID NO: 27457

SEQ ID NO: 108396 - DNA, 201 bp, Bos taurus
gtgattaaaagatttgaaaggtgttcttgggctggacacgaatagaggatggaggtgctggcttaaaccttggttattcaatacaatatacttttactaaggtgataagaaaaggggcctcctgctgagggcaggtttctgcaaagagctccttacaacactatctctattgagcctttttttggtacctttttaaggtag

SEQ ID NO: 108397 - DNA, 201 bp, Bos taurus
acaagtctcaaaaaatggatgtgcccagtagacaccaacaatataggtaagcatccatttgcccttacattccaccaaggccaggtattaccatcttagaccttccctttttccctgtggacacagaagttcagaactctatgatgagagcagagatgagtgatgggggcaggggtatggatggacagacgtatggccgat

SEQ ID NO: 108398 - DNA, 201 bp, Bos taurus
gaactgaataaagggtagatgggagtgagagggagaaactaagatttcaaatttcactctaacagggagtgggagaggaggaaggccaagaatcaagagtcctttagtcccagattcaagctcgaaacttgaattcaagctccaggcttctaaggaaacaaattatggtggttcattcattctcatgaaggactgtggttc

SEQ ID NO: 108399 - DNA, 201 bp, Bos taurus; identical to SEQ ID NO: 27462

SEQ ID NO: 108400 - DNA, 201 bp, Bos taurus; identical to SEQ ID NO: 27463

SEQ ID NO: 108401 - DNA, 201 bp, Bos taurus; identical to SEQ ID NO: 27464

SEQ ID NO: 108402 - DNA, 201 bp, Bos taurus
aaaaataatgaccatgtactctgaggtttctaatgtgtaaagtcaaatgtataagagcagtagcataaataccgggaaggaagaaatgggcatacactgttgtaagttatagtttttatactataaagagtggtgtaatgtcactagacaatatagactgataaaggctcatgctggggatgggggtgggctaaagttcag

SEQ ID NO: 108403 - DNA, 201 bp, Bos taurus; identical to SEQ ID NO: 27465

SEQ ID NO: 108404 - DNA, 201 bp, Bos taurus; identical to SEQ ID NO: 27466

SEQ ID NO: 108405 - DNA, 201 bp, Bos taurus; identical to SEQ ID NO: 27467

SEQ ID NO: 108406 - DNA, 201 bp, Bos taurus
ctgttgtgagttgggcatcttagtcacaaactagtactacttgcaagggatatgccatcacccctttggcctaggagccagccagacaatgcgcctcttgaatgcccaatcctcattgtgattctgctggagcactgcctgttccctcgcctctctccaaaggtcagcccgaggtctgcactccaccgctaatgggtgcac

SEQ ID NO: 108407 - DNA, 201 bp, Bos taurus; identical to SEQ ID NO: 27468

SEQ ID NO: 108408 - DNA, 201 bp, Bos taurus; identical to SEQ ID NO: 27469

SEQ ID NO: 108409 - DNA, 201 bp, Bos taurus; identical to SEQ ID NO: 27470

SEQ ID NO: 108410 - DNA, 201 bp, Bos taurus; identical to SEQ ID NO: 27471

SEQ ID NO: 108411 - DNA, 201 bp, Bos taurus; identical to SEQ ID NO: 27472

SEQ ID NO: 108412 - DNA, 201 bp, Bos taurus
agcagtgtgtacatgtccatccccaattccctaactatccctttcccccattctcccctctgttgactctcttttccattgttaaaacagtctttactaacttaggcatgtttgtagtcctgccacagttccatttagagataacatatatatttgtatgatgttgcctgaattttttgaaattcccagcatctgagatca

SEQ ID NO: 108413 - DNA, 201 bp, Bos taurus
ttaaaaatcttgctaattttttttgcttttttgagacatatctagtatttattatttttcaacttgaaataatacatagggcaaatgattttgggtgacactctctaaattgataacagtttttggagcaaaaattgaatttttggtggtaacattatagagatggatggatagatggaaggatggaaggataatggatgg

SEQ ID NO: 108414 - DNA, 201 bp, Bos taurus; identical to SEQ ID NO: 27473

SEQ ID NO: 108415 - DNA, 201 bp, Bos taurus; identical to SEQ ID NO: 27474

SEQ ID NO: 108416 - DNA, 201 bp, Bos taurus; identical to SEQ ID NO: 27475

SEQ ID NO: 108417 - DNA, 201 bp, Bos taurus; identical to SEQ ID NO: 27476

SEQ ID NO: 108418 - DNA, 201 bp, Bos taurus
gccaccgcctggccactgccccattgttcgtcaagcctccagcagcaggaggcaggggacatgtggagtctctctcaccctccggccccacatccaggccttttcatcataccacagacagaccctttccaagaacttgaatggggatccacaacctcccctctgatcgctcattaatctgccccttcagacattcctctg

SEQ ID NO: 108419 - DNA, 201 bp, Bos taurus
aaaggtgaaccctggacatctctgactctcatgataggctgtctcactttcctttgtccactaaagccctcacccaggccctgttgctagtaaaccaaggctccctggagcagcgagctatcacgcctgcacctctgtaccagtggcttccaagctgggcagattctggctttgttcagcctctacaggtatacagatggc

SEQ ID NO: 108420 - DNA, 201 bp, Bos taurus; identical to SEQ ID NO: 27477

SEQ ID NO: 108421 - DNA, 201 bp, Bos taurus; identical to SEQ ID NO: 27478

SEQ ID NO: 108422 - DNA, 201 bp, Bos taurus; identical to SEQ ID NO: 27479

SEQ ID NO: 108423 - DNA, 201 bp, Bos taurus; identical to SEQ ID NO: 27480

SEQ ID NO: 108424 - DNA, 201 bp, Bos taurus
aaatcactcactcactcacatgggcacaggcgacacatccaagaacattcaatgcagcattgttttttgttttgggggaggtttctgatcagagagaaaagaagtactttttaattccttcttaactgcaaaagccctttatctcaaatgccaacatatacatttatttctagctagtaaagcatatgagaaccgcagcct

SEQ ID NO: 108425 - DNA, 201 bp, Bos taurus; identical to SEQ ID NO: 27485

SEQ ID NO: 108426 - DNA, 201 bp, Bos taurus; identical to SEQ ID NO: 27486

SEQ ID NO: 108427 - DNA, 201 bp, Bos taurus; identical to SEQ ID NO: 27487

SEQ ID NO: 108428 - DNA, 201 bp, Bos taurus
cccgaaggcagctttaggtgctgataaaggcctttatgctaacttggcgagtggtataacacaggtgtttaagtttacaaaaacccatctaaaagtgtgccaacaactctatggccaaaatggtttaaaactaaatacggcaaaaccagtgtgctttgtctctaaggcatatctgttttcaagcccataacttctatttgt

SEQ ID NO: 108429 - DNA, 201 bp, Bos taurus
ggtatttccagctcactggtaacttcctggaggcagcaatatctttggcaggaagccatctcttctgtcaccttggccacaaggccctgctccaggccttaaattgataatccacaggagtggacccttctcctgagtcattccctcctggagaggcaaggatagaagagggcagctcttaggacccattggcaccctcac

SEQ ID NO: 108430 - DNA, 201 bp, Bos taurus
catttcagggccaaatgcttaccactaggaagccaaatccaacaaagagtgcaacagtgacagtggtagcagccagggaaatgaggatgattttgctgggcgtcaggggccccgggggtttcgctgctgttactgaatctgttccctccagttgagtgtctggatgtttagtggtgtagtcctctgtggtccccaggtctg

SEQ ID NO: 108431 - DNA, 201 bp, Bos taurus
gatggtactgcggatggtggaggcagaagattgaggaaatgtgaccatggctgatggagaagtgggagatctattcaattatggaagtggccacccacagagaagagggtgtgcaggaacagggtctgatactcttgtgatctagtcactgggtataaggatagtgctggaggaagagatgacagaataagatttacccat

SEQ ID NO: 108432 - DNA, 201 bp, Bos taurus; identical to SEQ ID NO: 27488

SEQ ID NO: 108433 - DNA, 201 bp, Bos taurus; identical to SEQ ID NO: 27490

SEQ ID NO: 108434 - DNA, 201 bp, Bos taurus
tgggactttcttcttttttcctatgactcccagttctacattttcaaagcctctttcattactcatctgctgtgccgattccctgaacgccgaggcggccacagctcccgaggcattcacggcttctccctcctcacagctcgctggctcccgctccatcgctgtcgacgccacaggactgctggcgcggcaggtcccgcc

SEQ ID NO: 108435 - DNA, 201 bp, Bos taurus; identical to SEQ ID NO: 27494

SEQ ID NO: 108436 - DNA, 201 bp, Bos taurus
cttaacagagtgaaccaagctactttcagtttctgtacttttaatttttgataggttcggccagtgagaaagggcatgagactacgatcccaatagcccgagagctcaggacagtctgtaatcaccgagtctgtgtacatgtctttccgtttccatcaggctccttttgctgccaggacgcccctaggttaataagcgttc

SEQ ID NO: 108437 - DNA, 201 bp, Bos taurus; identical to SEQ ID NO: 27495

SEQ ID NO: 108438 - DNA, 201 bp, Bos taurus
gcttttattcctaattgcagactacaagacttttttgatcttatctttcccaagacactatgctgacatagtccagagctccttgttttcaccccaggccattctcttttgggctagtcttgggaacgatcagcaagtgcgtaggcagcattcatgtctgatgccaatctggtgttccaaggtccattctttcatgatcca

SEQ ID NO: 108439 - DNA, 201 bp, Bos taurus; identical to SEQ ID NO: 27496

SEQ ID NO: 108440 - DNA, 201 bp, Bos taurus; identical to SEQ ID NO: 27497

SEQ ID NO: 108441 - DNA, 201 bp, Bos taurus; identical to SEQ ID NO: 27498

SEQ ID NO: 108442 - DNA, 201 bp, Bos taurus; identical to SEQ ID NO: 27499

SEQ ID NO: 108443 - DNA, 201 bp, Bos taurus; identical to SEQ ID NO: 27500

SEQ ID NO: 108444 - DNA, 201 bp, Bos taurus; identical to SEQ ID NO: 27501

SEQ ID NO: 108445 - DNA, 201 bp, Bos taurus; identical to SEQ ID NO: 27502

SEQ ID NO: 108446 - DNA, 201 bp, Bos taurus; identical to SEQ ID NO: 27503

SEQ ID NO: 108447 - DNA, 201 bp, Bos taurus
tgatcttgatgttacttggatcttccctgggtctccattcattgcctgcccagccaggccactatttggggctggaagatggagaaagaccactaagatcctcttttatggagtcctgggtctgagaccataagaattagtcactcaccagcataggaccgagcttttttccaatctgcaatagaaaaaagagacgtgagt

SEQ ID NO: 108448 - DNA, 201 bp, Bos taurus; identical to SEQ ID NO: 27504

SEQ ID NO: 108449 - DNA, 201 bp, Bos taurus
cttgagttcttgctcctgaaaaatggagatgatgctggcagcttgaaggattcttgtgaggtttcagtgaattaattcatataaagtgctcagtacttgatagacatgccttcattatgcagtgatctctcttttatgtatttgtttccttttctatgtgtgtgtgctaaagtactaggttgaccaaagatgttttggaaa

SEQ ID NO: 108450 - DNA, 201 bp, Bos taurus
gcgaagtcttttgtcatctgaacccccagggaatgccaagaattcgggagtgggtagccttcgctttcaccagaggaacattccggacccaggaattgaatcggggtattccacagatctttactagctagctactgtaaagtgagcccagctttttcaagtgtattaggtggctctgaaaagagcctttgggttgttgaa

SEQ ID NO: 108451 - DNA, 201 bp, Bos taurus
actctgactacctgggggccaggctggtgggtcctgccgggcagagagacagaccgcaatgagtgaagaccatggggtcagacagacgatcaacgctgtcagcttctggcctccgtggagtacccttggaaaggggttgaaggattttaagggggaaacgatccacttggatctgcatttcagaaaaccatgggggcaact

SEQ ID NO: 108452 - DNA, 201 bp, Bos taurus
cacaaaaagcctaagggaagactttggaactaggattgaactagcaaattctgcttttctgagactgttgagggacagtttgttctttaatttcccccagagataattaagtacacagtccaaccaaaatgctaaaaaaatatgttaattatatttgtaagaaactctcacatatttcatgaaagtatattattcttttct

SEQ ID NO: 108453 - DNA, 201 bp, Bos taurus; identical to SEQ ID NO: 27505

SEQ ID NO: 108454 - DNA, 201 bp, Bos taurus; identical to SEQ ID NO: 27506

SEQ ID NO: 108455 - DNA, 201 bp, Bos taurus
ttcatttccatcaaggtacggggtcggcactgctgtgtgctgtctttgctgctgccacagctgaatagtctgtcatggagacctgtccctgagacgtctgtctgctgcccctgcaccccccagaccgctgtctgtgcttgtagcacatccccagacccaccctttgtgtcagagcgggcagtgcaaatgtgagacgggctt

SEQ ID NO: 108456 - DNA, 201 bp, Bos taurus; identical to SEQ ID NO: 27507

SEQ ID NO: 108457 - DNA, 201 bp, Bos taurus; identical to SEQ ID NO: 27508

SEQ ID NO: 108458 - DNA, 201 bp, Bos taurus; identical to SEQ ID NO: 27509

SEQ ID NO: 108459 - DNA, 201 bp, Bos taurus; identical to SEQ ID NO: 27510

SEQ ID NO: 108460 - DNA, 201 bp, Bos taurus; identical to SEQ ID NO: 27511

SEQ ID NO: 108461 - DNA, 201 bp, Bos taurus; identical to SEQ ID NO: 27512

SEQ ID NO: 108462 - DNA, 201 bp, Bos taurus
aacacagctggtatactagttaggatttttcagagaattagaaccaaaaggataaaaggagatttattatgaggaattgtcccacacaataatgaggcctaagaagtctcatgaaccgccatctgcaggctggagaccctggaaagctggggagacagttcagtctgagtctgaggcctgagaacgggggagccaatgcta

SEQ ID NO: 108463 - DNA, 201 bp, Bos taurus; identical to SEQ ID NO: 27513

SEQ ID NO: 108464 - DNA, 201 bp, Bos taurus
tcctgcatttccagtattggcaggtgggttctttcctgctgagccacctgggagtcccttttagttctattgttcagctccaagtcagaaagaactgctatccaaagttgattcttcctacctttacaacttctgccccctagtgaaattttctcctgctattctttctagctccaagctttcaaatatctgaatcttccc

SEQ ID NO: 108465 - DNA, 201 bp, Bos taurus; identical to SEQ ID NO: 27515

SEQ ID NO: 108466 - DNA, 201 bp, Bos taurus
aaaaaaaaagtgacttgcccaagaatacatacatatgggacagcaccactgaaatatgttctttggcagttcagtttcagaggccatattcttaaccactgtaatattgtattaatattagaagagtgtccttcataagttttgacattctatgaagagcaatacagtaacattcagttactggcctcaataagcagacct

SEQ ID NO: 108467 - DNA, 201 bp, Bos taurus; identical to SEQ ID NO: 27516

SEQ ID NO: 108468 - DNA, 201 bp, Bos taurus; identical to SEQ ID NO: 27517

SEQ ID NO: 108469 - DNA, 201 bp, Bos taurus; identical to SEQ ID NO: 27518

SEQ ID NO: 108470 - DNA, 201 bp, Bos taurus
tgtttccattcagtaaccaccgctgctattcttgacatagcaaggccatttcttcaaatgtaatcttacatggaaatctgtaaaagaggggaaaatcgacacattctggatagcaaaggagttattgttaaatcctgtcaaaatatcccctctttggctgttcctggatgactctatagaatatatatggctctgttcaat

SEQ ID NO: 108471 - DNA, 201 bp, Bos taurus; identical to SEQ ID NO: 27519

SEQ ID NO: 108472 - DNA, 201 bp, Bos taurus; identical to SEQ ID NO: 27520

SEQ ID NO: 108473 - DNA, 201 bp, Bos taurus
ttcacaaagagacagagttctgactgaactcaccccagtccacccaataaacctttctctagagagctggtgtaaaagctgaaggtcaagaaacagagggggtcaagaatccgcctgccaatgcaggagatggaagggatgcgggtttgatccctgggtctagaagataccgtggagtaggaaatagcaacccactccagt

SEQ ID NO: 108474 - DNA, 201 bp, Bos taurus
caagatctttgctcatataattagttaagtgaataagtgggtgagtatataaatacatagtaagctgcattgtggttcagaaagcttctttaaaattgggtttaaacagtccatttaacctgacagcaaacttccatactgtttcctcaatggctgtattattgaactttatcatcagctttgtatatttccagttgttct

SEQ ID NO: 108475 - DNA, 201 bp, Bos taurus
gcaggttcaggaagctgaccccagacttgctgaatgaggatcctttagtgtgaaggaccggaaatcagacttttaacaactttcccaactgagtctcccagccactaaaatttaatcactgttgtccataaatagtggctctgcttacagttcctaatgcatagaataacaacgttacttaaaatattgactttatcaagt

SEQ ID NO: 108476 - DNA, 201 bp, Bos taurus; identical to SEQ ID NO: 27521

SEQ ID NO: 108477 - DNA, 201 bp, Bos taurus; identical to SEQ ID NO: 27522

SEQ ID NO: 108478 - DNA, 201 bp, Bos taurus
ttgataactaaaggccaacacaatataacagagaaagctcttggcttgagagtcaagagaccaagattctcgtctaaacatttactcactagttgtgggaatttgcgtggccatttgacctctttgagctaaagtatgatctgtaaaacatcaagactggatatgattattaagacctatacttgttttaaaagtctatca

SEQ ID NO: 108479 - DNA, 201 bp, Bos taurus; identical to SEQ ID NO: 27523

SEQ ID NO: 108480 - DNA, 201 bp, Bos taurus
tgactcagtcaaaagaaaaccaagttgtctacctaaaatgagctaaattgtaagatttttctctcttcagataatgccacccctaagaactcagtttctacaatgttactgccctagagacactgtaaattctgtattgaagacaaaaacagaaatatgagaagcccagacacaagtcctctcattgtcctgagtaataga

SEQ ID NO: 108481 - DNA, 201 bp, Bos taurus; identical to SEQ ID NO: 27524

SEQ ID NO: 108482 - DNA, 201 bp, Bos taurus; identical to SEQ ID NO: 27525

SEQ ID NO: 108483 - DNA, 201 bp, Bos taurus; identical to SEQ ID NO: 27526

SEQ ID NO: 108484 - DNA, 201 bp, Bos taurus; identical to SEQ ID NO: 27527

SEQ ID NO: 108485 - DNA, 201 bp, Bos taurus; identical to SEQ ID NO: 27528

SEQ ID NO: 108486 - DNA, 201 bp, Bos taurus; identical to SEQ ID NO: 27529

SEQ ID NO: 108487 - DNA, 201 bp, Bos taurus; identical to SEQ ID NO: 27530

SEQ ID NO: 108488 - DNA, 201 bp, Bos taurus; identical to SEQ ID NO: 27531

SEQ ID NO: 108489 - DNA, 201 bp, Bos taurus; identical to SEQ ID NO: 27532

SEQ ID NO: 108490 - DNA, 201 bp, Bos taurus; identical to SEQ ID NO: 27534

SEQ ID NO: 108491 - DNA, 201 bp, Bos taurus
ggtcagtgacagcaaaagaaacaggcagcatattggaaaaaagaaggaaaaataaaaagaaatgaaggaaagaagttctttggggacttttgaggttcacgtctcccatcactataggaatgttccaagggctataaaaacttacagataagaataaaatgttgcttcgttactcattttggttggatagaagccaagcat

SEQ ID NO: 108492 - DNA, 201 bp, Bos taurus
gccgcggttacctctacttctgtaccctgctgcattttaattagccctagtccctcgacaacttcttcagtgcttcgttattgccatcttcaaggaactcaagtaaggctttttatatttcatgtcgctaattggaaaaaatgttgaacatcctagtagtggggcttgatgaggcgcttcttagaacaatacagtcttggc

SEQ ID NO: 108493 - DNA, 201 bp, Bos taurus; identical to SEQ ID NO: 27537

SEQ ID NO: 108494 - DNA, 201 bp, Bos taurus
caaatgatcttcaaaagtcattaaacatgaaaaatactattttcctgttagcatacataactgtcagtcaacatggaaactaacagacatagatttacttcctctgagaatcagggaagttgtacaaactctcatgagctgatctcttaattcctctacttacaggccacttgctaacttcaagacatctctttctcacac

SEQ ID NO: 108495 - DNA, 201 bp, Bos taurus; identical to SEQ ID NO: 27538

SEQ ID NO: 108496 - DNA, 201 bp, Bos taurus
tccgtggtctacagcagtgattctcaaagcttggtcctgagctaagagcatcagcatcccctggggacttgttacaagtggaagatctcaggccgaggtatggctcaggactttttggagtgaggctctccaaatgagcctaatgcactctcaagtgtgagaatccctgggctgttactgtccacacaaaatcattttttc

SEQ ID NO: 108497 - DNA, 201 bp, Bos taurus; identical to SEQ ID NO: 27539

SEQ ID NO: 108498 - DNA, 201 bp, Bos taurus; identical to SEQ ID NO: 27540

SEQ ID NO: 108499 - DNA, 201 bp, Bos taurus; identical to SEQ ID NO: 27541

SEQ ID NO: 108500 - DNA, 201 bp, Bos taurus; identical to SEQ ID NO: 27545

SEQ ID NO: 108501 - DNA, 201 bp, Bos taurus; identical to SEQ ID NO: 27546

SEQ ID NO: 108502 - DNA, 201 bp, Bos taurus; identical to SEQ ID NO: 27549

SEQ ID NO: 108503 - DNA, 201 bp, Bos taurus; identical to SEQ ID NO: 27550

SEQ ID NO: 108504 - DNA, 201 bp, Bos taurus
ggatgatctgacattcagatgatccagaagggctctatttaccccgccttgttccatgagactggacggcaggaggcctgagaaatgaagaatcaggggaaatgatacagccaaagagctccaacctctccaaaggggaataactacaagctccagaaaggccaagtgccagtccgcattacacaacggcatttgccagaa

SEQ ID NO: 108505 - DNA, 201 bp, Bos taurus; identical to SEQ ID NO: 27552

SEQ ID NO: 108506 - DNA, 201 bp, Bos taurus
agatgcacctgtcacccaaagatgctcagttgagggtggggggatttgctggtctacaaagtcgatttgttgaaggttaggtggtggatggcctcagtatcatttggaaacagtgtctggaatgttccaagactctccactcatctcttagttgagtttttcctctcagaagactttcttcccaaagctggaactacacat

SEQ ID NO: 108507 - DNA, 201 bp, Bos taurus; identical to SEQ ID NO: 27553

SEQ ID NO: 108508 - DNA, 201 bp, Bos taurus; identical to SEQ ID NO: 27554

SEQ ID NO: 108509 - DNA, 201 bp, Bos taurus; identical to SEQ ID NO: 27557

SEQ ID NO: 108510 - DNA, 201 bp, Bos taurus; identical to SEQ ID NO: 27559

SEQ ID NO: 108511 - DNA, 201 bp, Bos taurus; identical to SEQ ID NO: 27560

SEQ ID NO: 108512 - DNA, 201 bp, Bos taurus; identical to SEQ ID NO: 27561

SEQ ID NO: 108513 - DNA, 201 bp, Bos taurus; identical to SEQ ID NO: 27562

SEQ ID NO: 108514 - DNA, 201 bp, Bos taurus; identical to SEQ ID NO: 27563

SEQ ID NO: 108515 - DNA, 201 bp, Bos taurus
gccccagcaaagctgatgcctttcctgggtttctttttctatagtgttatgtaaattcctgtcaaacctacgcacccactgtgtggtttcctcagtttctatcttactcactctcctggtgagcaatggttccagggtgcactgatgaggaggagaagagggcatcttggtgacgtctgctctgagatggtgagatgtcca

SEQ ID NO: 108516 - DNA, 201 bp, Bos taurus; identical to SEQ ID NO: 27564

SEQ ID NO: 108517 - DNA, 201 bp, Bos taurus
catgtcccatgaaaacaagcagggctctgctactaacaatttccacttgagtacaagcagcttcctaacactgagttttctttaagtcccttaactccaagtttataatgaaaggcttgtccaatatataataatattaggataacaaaatggtgggtgcaaaagatttttttttccacaagctgggttgctttactattt

SEQ ID NO: 108518 - DNA, 201 bp, Bos taurus; identical to SEQ ID NO: 27566

SEQ ID NO: 108519 - DNA, 201 bp, Bos taurus; identical to SEQ ID NO: 27567

SEQ ID NO: 108520 - DNA, 201 bp, Bos taurus
tagttcagctatgattcagatgtatataaatgtgatattaaagttgagattgaattgcaataataacaacttccatgagtgtaataccgatccaatgttaacgatgcattaggtagattgaagtcagcaagattacatctgggcttttatttgaaataaagcagttaatttacctagcagagaaataccattatcacaatt

SEQ ID NO: 108521 - DNA, 201 bp, Bos taurus
atagatgcctttggtgtgaagacactgatttttcttagaggaaaatgcatttatttaaagatgggaggcttttcattttattcccatctttcccttattgcttataaagtgctagccttgaagagccaagctttcctgtagaaaaatctaccgtatttatgaagtgatccttgagtaccaccagtttttcttcttaaattc

SEQ ID NO: 108522 - DNA, 201 bp, Bos taurus
gtttcgtttctcatctttgatcctggcaaaacctttgagtattaggataaattttaaaagtgtcttctcttccatgcaccatacatctgatggcaggagcacgtgccccagctggagcaggttaccccacaccctgggctggtagaaacagcgccttccagtcacgacccctcggctgtggtacagatgcagtcatttcaa

SEQ ID NO: 108523 - DNA, 201 bp, Bos taurus
cagctgcttccacggccaaacagtactatttgaaacagtcaagataccttccgggtaagtagagaccacaaagtgtttcctggtggcgaaagcatgctagcaggtcatgctccagggcctctgagtctttgacgaaagggcgcccgtgacccgccgctgcagccctccgctggcctgcctgtcaccaggtactgttctgga

SEQ ID NO: 108524 - DNA, 201 bp, Bos taurus; identical to SEQ ID NO: 27569

SEQ ID NO: 108525 - DNA, 201 bp, Bos taurus
tagtgactaacctgggtggactgtaagctgttggtgattttgacagcagaagactacctggttggcatgaaagcaatactttggcaggaaaaacatggggcgcaagaggatggtcacaccccaggtctcaggtgagtccctggagagggctgccatgtgagggtccctggttcctcacagaaaggacttcaagagccagcc

SEQ ID NO: 108526 - DNA, 201 bp, Bos taurus
atgccccctgcatgagtggcagcctactatggcagagggtgcccgctggctggcccaacaggcgtgggcatactcctcttgtaacagcactctagacttatgtggggtgctcattgttgctcagctgaaaaccttcatttcacaggctttcctttacctaattatgtttgcttagtaactaagttgtagatactggaatgg

SEQ ID NO: 108527 - DNA, 201 bp, Bos taurus; identical to SEQ ID NO: 27570

SEQ ID NO: 108528 - DNA, 201 bp, Bos taurus; identical to SEQ ID NO: 27571

SEQ ID NO: 108529 - DNA, 201 bp, Bos taurus
ctctttcttttatttatttattttcttttaaatatttatttatttggctgcaccagatctcggctgtggcaagcaggatctttagttgtggcatatgaaccgtgaacccgtagttatggctgctgggatttagttccccgaccagggattgaacctgagccccttgcattgggagtgtgtggaaatcttagcactgggcca

SEQ ID NO: 108530 - DNA, 201 bp, Bos taurus
aaagaggtaatgaataaaggaagtattggagaaaaatagctggagacttgttgttgactagctatacactaaaggttgaatataaataggaggaaatctcgtagtataacactaatgttgttcaagcaggaggagaaagttttgttggtttttgagcttgccaaagggtttgggcagtctaggtcagaccaacatctggag

SEQ ID NO: 108531 - DNA, 201 bp, Bos taurus
tttattttctaccatggacagatatggatatcaaccagcaaataacaagaaataaagggggaaggacaggattagaagaaaagctgtgaacttgattttgaacctactgagtttgagctttctacattatatccaaatataaatgtttgggggatctttggaaaaaatgcatgtgaaacttgagagagagatggaagtttg

SEQ ID NO: 108532 - DNA, 201 bp, Bos taurus; identical to SEQ ID NO: 27572

SEQ ID NO: 108533 - DNA, 201 bp, Bos taurus; identical to SEQ ID NO: 27573

SEQ ID NO: 108534 - DNA, 201 bp, Bos taurus; identical to SEQ ID NO: 27574

SEQ ID NO: 108535 - DNA, 201 bp, Bos taurus; identical to SEQ ID NO: 27575

SEQ ID NO: 108536 - DNA, 201 bp, Bos taurus; identical to SEQ ID NO: 27576

SEQ ID NO: 108537 - DNA, 201 bp, Bos taurus; identical to SEQ ID NO: 27577

SEQ ID NO: 108538 - DNA, 201 bp, Bos taurus; identical to SEQ ID NO: 27578

SEQ ID NO: 108539 - DNA, 201 bp, Bos taurus; identical to SEQ ID NO: 27579

SEQ ID NO: 108540 - DNA, 201 bp, Bos taurus; identical to SEQ ID NO: 27580

SEQ ID NO: 108541 - DNA, 201 bp, Bos taurus
aagacgagggacccctgggaagaagaggggctcggtgtctgggtgatggcgcccagccgcacacggtgagtctgggtccgagagctcagagggcatcaccaattagggtcatatcagtgcagtaggtaccagctgttgggtgaggtttcctgaggtaggcagagcaggcggtctctacatggctaaaattctgctagttca

SEQ ID NO: 108542 - DNA, 201 bp, Bos taurus
acacaggctggaaaccctagaagccaaccgtagaaggaggaggaaaggagaagaatgccgagtgctgcttcttagaattcagtttcaagacagaaaatacgtggggttatttgcactctcttttgggagtcatgacacaagtatgatcgtgggatgatcgtattgtgattttcgagggacagatcactattgataaatcac

SEQ ID NO: 108543 - DNA, 201 bp, Bos taurus
ccacagtggacttctgaccgtgacaacggagctatttggttttgatgaaacattcaagtcttaaaagttaagagtaactgacaggccagtttctcgccccagttcccagggtgaccagggtttcagattcctggtcagttacactgcatcagatgacctgttattatccacggcccagcgtcgggcgtgccaagcacagga

SEQ ID NO: 108544 - DNA, 201 bp, Bos taurus; identical to SEQ ID NO: 27581

SEQ ID NO: 108545 - DNA, 201 bp, Bos taurus
tcttctcctttggaaaccagcttagatgcttccagacccacccaatattataaccgcccccggaacaccaataaatgcccttatgtccaaggcaacacaagcccaaagcatatggaagttaaaaactccaaccaaaatgcagggcatgtaacgacctagtctgattcaagaaacagaaaacatggagcactcctgttttat

SEQ ID NO: 108546 - DNA, 201 bp, Bos taurus
acacctgtctggtccatctccagatttatcgggaggatgaaagatgaggatgtacatgagagtgcttggaaaactgtagatttctatgcaaacaggccagcaaattattatggtctgaattgtgtccctccccacttccctgttcatatgtggaagtctggacccccaatatggctgcatttgaagacacggcctttgagg

SEQ ID NO: 108547 - DNA, 201 bp, Bos taurus; identical to SEQ ID NO: 27583

SEQ ID NO: 108548 - DNA, 201 bp, Bos taurus
aaaatcactaaattaaaaataataaaatcattaaattttaaatgtcaacaaatagcaagacattataaaatttgtaaaaataacattttaactaactcttgatatctgctttccctctacaagtgcttgttcctcctagatttttgggaatgtcactctcttcagatggcaactttgtcatagttttctataaggagacta

SEQ ID NO: 108549 - DNA, 201 bp, Bos taurus; identical to SEQ ID NO: 27584

SEQ ID NO: 108550 - DNA, 201 bp, Bos taurus; identical to SEQ ID NO: 27585

SEQ ID NO: 108551 - DNA, 201 bp, Bos taurus; identical to SEQ ID NO: 27586

SEQ ID NO: 108552 - DNA, 201 bp, Bos taurus
taggggccatcgctctgctgggacagcctggctctgtccccgactagttttggtgacttggcggggggttcctttaactcctggtcccccattttcaaaagcgattcttccaccaactgagagaaagtctagagggacggttcctgcctgcttagtgctgggggcgaaggagcaaggtgacgggggtgttcgatcagcagg

SEQ ID NO: 108553 - DNA, 201 bp, Bos taurus
ggcatatgcacctgaaaattaaaatttattaatgttaacataatgaaatcaaaatgattttatgtaatttcatgatttatattttgggggaaagttatttaaatgtaatttataggcctttccccccagcatacctgcttttgccctcattttccttggcaagaaaaatcccaaggtttcttaagtctcttctcatgtaaa

SEQ ID NO: 108554 - DNA, 201 bp, Bos taurus; identical to SEQ ID NO: 27587

SEQ ID NO: 108555 - DNA, 201 bp, Bos taurus; identical to SEQ ID NO: 27588

SEQ ID NO: 108556 - DNA, 201 bp, Bos taurus; identical to SEQ ID NO: 27589

SEQ ID NO: 108557 - DNA, 201 bp, Bos taurus; identical to SEQ ID NO: 27590

SEQ ID NO: 108558 - DNA, 201 bp, Bos taurus
ggagcctgcccccaccaccggggatccctttccagtttatgctcatctgttcttatgctgctttcaatggcaaggccagtgcctgcgtctctgtcacacacacggtcatgggggctgcccgcagcctgccagtctgctccttctgctcacagagaagtgtctggaaatttgtgctctcccaagggcggcctgtggccaatg

SEQ ID NO: 108559 - DNA, 201 bp, Bos taurus
cacaggacaaccacagaaccagatggacaactttcaagaaagtccacctgggagattccacgacctctgccaaggcagcctccacgttgcctgccccgcacgcttacctcccatctcccgtacacatgaccggcgtgtcacagctttgtcgtccagcagtctgacttcatgtcacccttgtctagacactaaaactccttg

SEQ ID NO: 108560 - DNA, 201 bp, Bos taurus; identical to SEQ ID NO: 27591

SEQ ID NO: 108561 - DNA, 201 bp, Bos taurus
agacaggcctggcccaccccgaggcgaggtaggtggggctgttattcagagcaaaggctggggtgcagtcctagccgtgtccacaaggtgtcgcagtcattctacagaacagggggccccaacctctaggatctaatgcctgacgatctgaggtgaagctgatgtagtaataataatagtagacgtgacaagcacaacacc

SEQ ID NO: 108562 - DNA, 201 bp, Bos taurus; identical to SEQ ID NO: 27592

SEQ ID NO: 108563 - DNA, 201 bp, Bos taurus; identical to SEQ ID NO: 27593

SEQ ID NO: 108564 - DNA, 201 bp, Bos taurus
tcatgtaagtggaatcattctctgtcctcatgggggtggggggtgagctgatttagttctcggatgcagaggacggaaccgcaggtcagctcaggcccgatgtccagtttccaggagctgctgaggaccatgacgagccctgtgatgcatctgaaccagcggctcatcacgctgggccccatcctgggccccgggccccat

SEQ ID NO: 108565 - DNA, 201 bp, Bos taurus
ccaccggggcagtcccttttttgtatctttggccagacattgcaagttttatgttgctgacttcccattttgttacagtcctttaaatgtcgtaggacctcgttctggcccacagtgacattacttggaactagaaggacctttggaaacgtgcttctcggctttactagggtgagtccaaagttagtctttgacccaggg

SEQ ID NO: 108566 - DNA, 201 bp, Bos taurus
ccagcccccaccttgaatgaaacaacaaaggccgagaggcagccgtctccagaaaccctctgtgaaccgagcgatcgcagaagctacggggagcaggcccatcctctgcacagcttctggaaaggtctccctggttgtgaagagcccagggcacggaagctggggcagcgctcgtgagaaggtggaggccacgccctcagc

SEQ ID NO: 108567 - DNA, 201 bp, Bos taurus; identical to SEQ ID NO: 27594

SEQ ID NO: 108568 - DNA, 201 bp, Bos taurus; identical to SEQ ID NO: 27595

SEQ ID NO: 108569 - DNA, 201 bp, Bos taurus; identical to SEQ ID NO: 27596

SEQ ID NO: 108570 - DNA, 201 bp, Bos taurus; identical to SEQ ID NO: 27597

SEQ ID NO: 108571 - DNA, 201 bp, Bos taurus; identical to SEQ ID NO: 27598

SEQ ID NO: 108572 - DNA, 201 bp, Bos taurus; identical to SEQ ID NO: 27599

SEQ ID NO: 108573 - DNA, 201 bp, Bos taurus; identical to SEQ ID NO: 27600

SEQ ID NO: 108574 - DNA, 201 bp, Bos taurus; identical to SEQ ID NO: 27601

SEQ ID NO: 108575 - DNA, 201 bp, Bos taurus; identical to SEQ ID NO: 27602

SEQ ID NO: 108576 - DNA, 201 bp, Bos taurus; identical to SEQ ID NO: 27603

SEQ ID NO: 108577 - DNA, 201 bp, Bos taurus; identical to SEQ ID NO: 27604

SEQ ID NO: 108578 - DNA, 201 bp, Bos taurus; identical to SEQ ID NO: 27605

SEQ ID NO: 108579 - DNA, 201 bp, Bos taurus; identical to SEQ ID NO: 27606

SEQ ID NO: 108580 - DNA, 201 bp, Bos taurus; identical to SEQ ID NO: 27607

SEQ ID NO: 108581 - DNA, 201 bp, Bos taurus; identical to SEQ ID NO: 27608

SEQ ID NO: 108582 - DNA, 201 bp, Bos taurus; identical to SEQ ID NO: 27609

SEQ ID NO: 108583 - DNA, 201 bp, Bos taurus; identical to SEQ ID NO: 27610

SEQ ID NO: 108584 - DNA, 201 bp, Bos taurus; identical to SEQ ID NO: 27611

SEQ ID NO: 108585 - DNA, 201 bp, Bos taurus; identical to SEQ ID NO: 27612

SEQ ID NO: 108586 - DNA, 201 bp, Bos taurus; identical to SEQ ID NO: 27613

SEQ ID NO: 108587 - DNA, 201 bp, Bos taurus; identical to SEQ ID NO: 27614

SEQ ID NO: 108588 - DNA, 201 bp, Bos taurus; identical to SEQ ID NO: 27615

SEQ ID NO: 108589 - DNA, 201 bp, Bos taurus; identical to SEQ ID NO: 27616

SEQ ID NO: 108590 - DNA, 201 bp, Bos taurus; identical to SEQ ID NO: 27617

SEQ ID NO: 108591 - DNA, 201 bp, Bos taurus; identical to SEQ ID NO: 27618

SEQ ID NO: 108592 - DNA, 201 bp, Bos taurus; identical to SEQ ID NO: 27619

SEQ ID NO: 108593 - DNA, 201 bp, Bos taurus; identical to SEQ ID NO: 27620

SEQ ID NO: 108594 - DNA, 201 bp, Bos taurus; identical to SEQ ID NO: 27621

SEQ ID NO: 108595 - DNA, 201 bp, Bos taurus; identical to SEQ ID NO: 27622

SEQ ID NO: 108596 - DNA, 201 bp, Bos taurus; identical to SEQ ID NO: 27623

SEQ ID NO: 108597 - DNA, 201 bp, Bos taurus
tgagggccacccgccttccagcccagaagccctgcccttccaagtccacttgggtcgggcagacttctttgctgctggtgaccacagagtaagcatggaagtcaaagcagagaaccaaggccaaggtgaacattaatgtggctgctgcctggtgagatgttggttcatggggggccagaccccaacatgcaggtgacccct

SEQ ID NO: 108598 - DNA, 201 bp, Bos taurus; identical to SEQ ID NO: 27624

SEQ ID NO: 108599 - DNA, 201 bp, Bos taurus; identical to SEQ ID NO: 27625

SEQ ID NO: 108600 - DNA, 201 bp, Bos taurus
cctgcaatgctttaggtgttagtagcaaaaagtcaaattagagtcagtaatgacacagacatattcttcaagcggactgcctcctggcctgatggggcacatgtatagctttaccaccgattaatgatactgagtcttactctacaccggcactctcaaagtccaagcaacttaggggaataaaccttcatctctcaagaa

SEQ ID NO: 108601 - DNA, 201 bp, Bos taurus
gcccttggtgactcctggtgattgagctccttacgcttctattcgtttcatgaaaaggtagcccaggtgtgcctgccctgaggcccagtaccttcctcccaaccccgtggcaccagagtctcagcccctcgccgtgacacctggcagcctcacccttgtacctgctgggctggcacccacgtggtcagctcctctcaccac

SEQ ID NO: 108602 - DNA, 201 bp, Bos taurus
aaaaccctaggagctaaatgcttaacatcggaatctctcaacgtctaaacgcacctattgttcattgtactaactttacaatgtcacttccagagtcaccgtcatggaggctagacttcagctcgctttgaaaagcatcagagtgctttggggcagctcatccactgttgtcattatgatagtgcttcgtaaatactgtga

SEQ ID NO: 108603 - DNA, 201 bp, Bos taurus
tattttagcaagaactttgctttcaccctgagactatactgtaccgagttatacgtttgggctattgtcactcagtcctgtaaacactggagtgaggaccgataaaccacacactcgggaccctccccgcaagacgcgggccactcaccctcctgagacccagccctgcggggccttccgccccgcccgctgccctctctc

SEQ ID NO: 108604 - DNA, 201 bp, Bos taurus; identical to SEQ ID NO: 27627

SEQ ID NO: 108605 - DNA, 201 bp, Bos taurus; identical to SEQ ID NO: 27630

SEQ ID NO: 108606 - DNA, 201 bp, Bos taurus; identical to SEQ ID NO: 27633

SEQ ID NO: 108607 - DNA, 201 bp, Bos taurus
ccacatggttacgttatcagcacattaaagcaggagtgcttagagacaggaagaaacagataaggactacggtcttcacagaactcattctaataccttccacatcttggaaggtgagaaaccagcagaggttgcaagtgtcctgccatggcatctcctgtcctttgtccctaggtcaggagaacacgctcctcacgtcca

SEQ ID NO: 108608 - DNA, 201 bp, Bos taurus; identical to SEQ ID NO: 27635

SEQ ID NO: 108609 - DNA, 201 bp, Bos taurus; identical to SEQ ID NO: 27636

SEQ ID NO: 108610 - DNA, 201 bp, Bos taurus; identical to SEQ ID NO: 27637

SEQ ID NO: 108611 - DNA, 201 bp, Bos taurus; identical to SEQ ID NO: 27638

SEQ ID NO: 108612 - DNA, 201 bp, Bos taurus
aattgaaaaaatagaaataaaaaacagctgagtggttggttttctgtctcggctttattgcacagttcaaagccaggattacggaggtcattaagcagcattgtctctgtgacatgattagtcaggtagcaaagtccatttgtcacctgcagcagcaaattgagttaatactgcactacaggctatggggactgtataata

SEQ ID NO: 108613 - DNA, 201 bp, Bos taurus; identical to SEQ ID NO: 27640

SEQ ID NO: 108614 - DNA, 201 bp, Bos taurus; identical to SEQ ID NO: 27641

SEQ ID NO: 108615 - DNA, 201 bp, Bos taurus
cttgtttttacagacattcttaacctaaagccaaaacgtgcactggcgctaccaagcggccgcgtcttattccactcaagggctctgatgtctacaaggcatgctgatagggacgcttgctcatatacacgctgcatccccactgcctgctcgttctcaggttttctttctcttcttccccttctttctttcagaatgttt

SEQ ID NO: 108616 - DNA, 201 bp, Bos taurus
gctgacagagaaaaaatatagtaatctcaaaataaactacataaaataccaagcttcagacactaaaggaaggaaaactagagcatgtctgggctcttgaaaggagaagaactctgtgtctatttacacagactacagtttgctcaatctataagtaacagttaatctgtaactcactgattctattacatgttcaatact

SEQ ID NO: 108617 - DNA, 201 bp, Bos taurus; identical to SEQ ID NO: 27642

SEQ ID NO: 108618 - DNA, 201 bp, Bos taurus; identical to SEQ ID NO: 27643

SEQ ID NO: 108619 - DNA, 201 bp, Bos taurus
aactaaaccctttaaaatgttatgtctggccaaaattttaagatgcataaagttcaaaaagaagtcaattgatactcatctacccacactcccagcgaaatggccttgcctatagtacctgatatcttgcctgtcatgtttttatagcatttatatgaggtgttgacccttaacccaaggacaccagacccccatgctggc

SEQ ID NO: 108620 - DNA, 201 bp, Bos taurus; identical to SEQ ID NO: 27644

SEQ ID NO: 108621 - DNA, 201 bp, Bos taurus
cttgagcacgtggcacatcacctttggaactatggaatcgtcagtctctagaaagcgtgatgactgaccagcaccttctcctcattggcgctttcatctactgagcatgtatttttcaagtgctgctccctgttggaaccactcgtttccagagacctggagctgtgagcacttagcacaggtggtgggcaggtgcaggca

SEQ ID NO: 108622 - DNA, 201 bp, Bos taurus; identical to SEQ ID NO: 27645

SEQ ID NO: 108623 - DNA, 201 bp, Bos taurus
ccatactccccacaaggaggcctttcccacctttgtggatgtcagcctctgctgtacttgaactcccagcagccaccacctgtggctctatgaaggatgatggccacatatataaagttctagaagactctgagagtataattacttccttctcaccagcatgatgggtgtggacccgtcttctggtggcaccagcccggg

SEQ ID NO: 108624 - DNA, 201 bp, Bos taurus
ccttgctgtggtgtcccggcgttttccttactgatgactcttagccattctgcaaataccaccaggcatctggaagtggtggcgagatactgaagccgacatgtccccatgggcagaaaagaaaggcaagtggagaacttcctcagccgtcactcggccattaaacaaatggcctggtagagacacaactgcgttgacctt

SEQ ID NO: 108625 - DNA, 201 bp, Bos taurus
actcagttaggttggctgagccttgaaagctgagttgaatgcatagttagtggcaatggctgtgaaggtcatctccacacagccttctaagctatttactatttcattcattaaatgtgtaaattggcaaaatcacttaacctagtgggtatacaatctgccacttacaaatgggatacagtaggcagtaggtcagagaag

SEQ ID NO: 108626 - DNA, 201 bp, Bos taurus; identical to SEQ ID NO: 27646

SEQ ID NO: 108627 - DNA, 201 bp, Bos taurus; identical to SEQ ID NO: 27647

SEQ ID NO: 108628 - DNA, 201 bp, Bos taurus; identical to SEQ ID NO: 27648

SEQ ID NO: 108629 - DNA, 201 bp, Bos taurus; identical to SEQ ID NO: 27649

SEQ ID NO: 108630 - DNA, 201 bp, Bos taurus; identical to SEQ ID NO: 27650

SEQ ID NO: 108631 - DNA, 201 bp, Bos taurus; identical to SEQ ID NO: 27651

SEQ ID NO: 108632 - DNA, 201 bp, Bos taurus; identical to SEQ ID NO: 27652

SEQ ID NO: 108633 - DNA, 201 bp, Bos taurus
caaaatagctgaagactagatgcgtataaatctgatttctaaaagttttgcttgacatcataaggaaacatttaagaagctaagtcttaggtgtcagtgtttgttaccaagctccaacccaacaatatctgctatgtttgccactgtttttagcatgattaatgaagaaatgctttattcataatttatttatttatcctt

SEQ ID NO: 108634 - DNA, 201 bp, Bos taurus
atgggtgggctctcctgacacttaggaatctcccagaagttccagacggaattttagagtgaatcgcaagctctttccaagggcctctactggatgctcacgagaagcctggttgaaggaggattcttgaaattatccacattggtggtgcctcagcaggaaatttcaccctcatctggcccatgtgtcactcagagcaga

SEQ ID NO: 108635 - DNA, 201 bp, Bos taurus
gcatttgagtggaaccctgggtcttcatagtcctcaggactatgtttcagattcatgctttttccagtgtttttatccaatttgtctctattcctctatatgtttcccagttctcaaattcacaaggaaataataccagatgggcaatcacaatggccctgtttaccaagcattgtgtgtatggttagtgactgaaaaaag

SEQ ID NO: 108636 - DNA, 201 bp, Bos taurus
actcctgaaagttagacattattgcaccatttaagctccaaaatgaaaagtttttgccttgaaggtgcaatgtattacaagtacatttcaatagaatccatgactgaatatcactttgcaatttgaaatatcactcaacaaatatcacccaaagggaaacattggccaacagcttatttggatatatcccatctatcaagt

SEQ ID NO: 108637 - DNA, 201 bp, Bos taurus
atcatttaacctgtagatccacagagatgtgtactatggaatttgtaaggccctcgtaagctccaaaattctgattctaaagttagtctcagcgcaagtcatcagcgcagaacaaaggaaagaggccctcagccctcactcggaggcagacatgagttcatcaagcagaaaactctctagtgagttgtcagtctttgaagt

SEQ ID NO: 108638 - DNA, 201 bp, Bos taurus
tagtggttgtactgatgtccattctcaccaacagtgtaagagggtttcccttttctccacaccttctcaagcatttattttttatagactttgatggtggcgactctgaccagatggagatgatactcattgtacttttgacacgactgagtgactgaactgaactgaactgaataatgagctacattgagcatctttccc

SEQ ID NO: 108639 - DNA, 201 bp, Bos taurus
agtgagattaatattttccagcttgctgacagcatctattctgcagcccatggatcaaaggagtaatttttacttttgagaattatattttgtaaggttattgcggtcataaatggttattctactgatggatctgatcaaagcaaattaaaaaccttctggaaaggattgatcattctaaatgccatgaaaagctttcat

SEQ ID NO: 108640 - DNA, 201 bp, Bos taurus
aagccagctcaagatctcagtcaactcttcccattagaaataaaaatgcccacatatatactgctttcagtgttcctattgatattgtatccctcaagctcttgacttaaatctttcctattcttccgaccttatgtcagtactacagactacaacagccttacctgagtgtctggtcattgtaccgtatctgatggggtg

SEQ ID NO: 108641 - DNA, 201 bp, Bos taurus
catcccctggtccactgagctctccccttcctcgccgagcacgtcttgtcttccctcagacctcctacatctcccctaccttcaatctcagctgaaggccaggctccctacttaccggagacaatcgagaccttcagaagcaaacgtgacaccgcagcgccgcggcagcccacgcccacccggctaccataaacccaccga

SEQ ID NO: 108642 - DNA, 201 bp, Bos taurus
acccagggctggacgcaccttggttcttcacggatgatgtgcagtactagggtcttgccctcttccttccaggtccctagagcatccctcagaggaagttgcaacacccttggccttgggcggggggcagctggcccaggggcaggagagatgtcgcctctgcttccaagcaatgaaggcaaggcgtaatggtttgatgcc

SEQ ID NO: 108643 - DNA, 201 bp, Bos taurus
ctcacttctgtgtcacgtcatgtattcgtttcccttagttaactgtaaagcgacacttggcggaaaaatcatgaaacctcgatgagacactataggactcgatcattggccatttcttttcacttctgagatttctctcttttttattcttatttattttgggctgcgctgggtcttcgttgctcagtgggctttctctag

SEQ ID NO: 108644 - DNA, 201 bp, Bos taurus; identical to SEQ ID NO: 27653

SEQ ID NO: 108645 - DNA, 201 bp, Bos taurus
agtggcctggatgctatgctctggacatgtgcatccatgtcccccgcttggctgtggtcattcctgcccctgcatgtcctttggcctagagcctggtccctacagctggctgtgccttcaaggtgagacttcagggctccgtgattctgaccaagggttgggaggccttggcattgacgggggcttgcttgaaagatggcg

SEQ ID NO: 108646 - DNA, 201 bp, Bos taurus
agaaccccatggagggaggagccctacaggttgcagtccatagggctgcacagagtcagacatgactgaagtgacttagcatgcatgtaaggcctcattatagctagtgtgaaagggaaatgacttaaaaatatttccctgtgtaagcaaaagctgattctattacaagtagcaaacttgggttgacttgactcctatcat

SEQ ID NO: 108647 - DNA, 201 bp, Bos taurus; identical to SEQ ID NO: 27654

SEQ ID NO: 108648 - DNA, 201 bp, Bos taurus
acaggcattgtttgcttaattctccaagcttgaatggaaacctcagaagtcagaccacctgggaacaaaatccagacacagccagataataaacaggcaccgataacatctgtagcaacagagagaccaagcttactaacagtcttccacagcacattctcaccacgataagccatgcagttcataggtggatcttaatgc

SEQ ID NO: 108649 - DNA, 201 bp, Bos taurus
actagaaaaacaaaaataaggaaggaaggaaagggaagagagggagagagagacagagggagggaaatccactttccatagaaagtcaactgaatgatatatgaaattctagcaggtcaactgctattaattatatgacagttacaacttcccagtgctctgagttagtcttttgctcagctctccatggcctagtatgtg

SEQ ID NO: 108650 - DNA, 201 bp, Bos taurus
acactcatttttatctgtaacttaatttagcaaaaagctagtatctcataaaatataagaattcatatcactaattcaaagattgttttcattaatatttcagtgtttcaaaaatacttctactggccatttgactgtaaaaagcagaggtcattaaggatgagaggaagcagtgtatatggctatcatttacatttatat

SEQ ID NO: 108651 - DNA, 201 bp, Bos taurus
agatataatctaatctttagataaaaatggattcttaaaaaaaaacaataccataatttctatgagaaaaatgatgtgtaataaactaatacacttgtagttcaaatgacatcaattatgattttgaaagttaatgaactaatcccctttctgtttattaacatcaagggtatctatataggttatatggactctgttttc

SEQ ID NO: 108652 - DNA, 201 bp, Bos taurus; identical to SEQ ID NO: 27655

SEQ ID NO: 108653 - DNA, 201 bp, Bos taurus; identical to SEQ ID NO: 27656

SEQ ID NO: 108654 - DNA, 201 bp, Bos taurus; identical to SEQ ID NO: 27657

SEQ ID NO: 108655 - DNA, 201 bp, Bos taurus; identical to SEQ ID NO: 27658

SEQ ID NO: 108656 - DNA, 201 bp, Bos taurus; identical to SEQ ID NO: 27659

SEQ ID NO: 108657 - DNA, 201 bp, Bos taurus
acctggaaaaggcagggaatagattatccccctggagcttctagagggggcacgtctaggagacatgttgattctggcccaattgatactgattttggacttcaggtgtacagaacaattaaacaataaatctctgttatttgaaggctccaagattgtggtgcttcgttacagaagccttaggaaactgacctaggcccc

SEQ ID NO: 108658 - DNA, 201 bp, Bos taurus; identical to SEQ ID NO: 27660

SEQ ID NO: 108659 - DNA, 201 bp, Bos taurus; identical to SEQ ID NO: 27661

SEQ ID NO: 108660 - DNA, 201 bp, Bos taurus; identical to SEQ ID NO: 27662

SEQ ID NO: 108661 - DNA, 201 bp, Bos taurus; identical to SEQ ID NO: 27663

SEQ ID NO: 108662 - DNA, 201 bp, Bos taurus; identical to SEQ ID NO: 27664

SEQ ID NO: 108663 - DNA, 201 bp, Bos taurus; identical to SEQ ID NO: 27665

SEQ ID NO: 108664 - DNA, 201 bp, Bos taurus; identical to SEQ ID NO: 27666

SEQ ID NO: 108665 - DNA, 201 bp, Bos taurus; identical to SEQ ID NO: 27667

SEQ ID NO: 108666 - DNA, 201 bp, Bos taurus; identical to SEQ ID NO: 27668

SEQ ID NO: 108667 - DNA, 201 bp, Bos taurus; identical to SEQ ID NO: 27669

SEQ ID NO: 108668 - DNA, 201 bp, Bos taurus; identical to SEQ ID NO: 27670

SEQ ID NO: 108669 - DNA, 201 bp, Bos taurus
gcatgactacccattccatggattccccattgcctggagaattccactggacagaggagcctggtaggctacagtccacagggccgccaagagtcggtcacgactaaagcaacctggcatgcacgcacaatggagacaatatttaaagactggacagtgaacagtacttaaggaaggaatctgccagaaggttagggccca

SEQ ID NO: 108670 - DNA, 201 bp, Bos taurus; identical to SEQ ID NO: 27671

SEQ ID NO: 108671 - DNA, 201 bp, Bos taurus; identical to SEQ ID NO: 27672

SEQ ID NO: 108672 - DNA, 201 bp, Bos taurus
catggcctcccaccctcaaccccttgacctttcatttatttttaaaatttttactgcaacctgggattctcttgtaagctctttccttttctctctacattcactatcacatggccgaggacttattccctcctatagaacatattgaagtgcaattcctacttctgtgctgagtcttgagtctccaacttccatccactc

SEQ ID NO: 108673 - DNA, 201 bp, Bos taurus; identical to SEQ ID NO: 27674

SEQ ID NO: 108674 - DNA, 201 bp, Bos taurus; identical to SEQ ID NO: 27675

SEQ ID NO: 108675 - DNA, 201 bp, Bos taurus
tgaaaacccattccagtactcttgcctgggaattcccatggacagaggagcctggcaggctacagtccatgggattgcaaagagtgggacacgactaggcccatgtttgcacacagcatgcctacatcttagcctatatcctttacatcttctcctctcatcagaggtacattctccttcctgctgtctaagaccaacatc

SEQ ID NO: 108676 - DNA, 201 bp, Bos taurus
ttcttaccagactttacagagacactgcaaggttctccgtggggactgagaagagcgtactgcaccgtgcctggatgaggaggttgataatgagtgatgccggaggttaaaagtactgccagtagcagcatcctcatctctagcaacatatacaggaaaactagcatccagccccacaaccccagatgggtgttatccttt

SEQ ID NO: 108677 - DNA, 201 bp, Bos taurus; identical to SEQ ID NO: 27677

SEQ ID NO: 108678 - DNA, 201 bp, Bos taurus
ttgacttgccaaccattttctgcagcccatatgaagcgggtcccctcctttctacctgtagctctaaggatctgatactaggaagtcacgactacatgaatctgtatttagtactagaacagggcacatattgctctcatgtcatcatttgatattctattcattcatactgtatttacaactagatttccttttataaag

SEQ ID NO: 108679 - DNA, 201 bp, Bos taurus; identical to SEQ ID NO: 27678

SEQ ID NO: 108680 - DNA, 201 bp, Bos taurus; identical to SEQ ID NO: 27679

SEQ ID NO: 108681 - DNA, 201 bp, Bos taurus; identical to SEQ ID NO: 27680

SEQ ID NO: 108682 - DNA, 201 bp, Bos taurus; identical to SEQ ID NO: 27681

SEQ ID NO: 108683 - DNA, 201 bp, Bos taurus; identical to SEQ ID NO: 27682

SEQ ID NO: 108684 - DNA, 201 bp, Bos taurus
tttaaaaaccaccatgtgaagcaaaaacaaaatctttatatctaattgaaaaagttcataaaaggaagaaaaaaattgaatcacagctttgcaaagcttggttactagattgctgtcaggaataccatttctatctaggacatcataatacttacagaatttttatctttcatagatttctgtacatacgtcattaaaata

SEQ ID NO: 108685 - DNA, 201 bp, Bos taurus
actaaagtcatttgtttgtggctgctgatagaaaatggtaaagcatataactaattatataataaatataaataatatctcctagggcctttttagtttatagagtacttgcatgtgccttgtttcatttaattattataatagtattgacaggtaatattacagcttaattacagaatagaaactaatgcctcacgtgtc

SEQ ID NO: 108686 - DNA, 201 bp, Bos taurus
cttaaaatgatgaaaggaaaaaaacctacaaccaagactacccaacaaggatcatactaaaggagcttctctagacaggaaacactggaaaggcctataaacaatgaagtagatggtaatgtgtcatcagttcagttcagtctctcagtcatgtccgactctttgcgaccccatggactgcagcatgccaggcctccctgt

SEQ ID NO: 108687 - DNA, 201 bp, Bos taurus
caagcccagatttctattgttccatagttccttcctttttctcctgaattaggtttcatctccatatctccacttaaagataaattatgctcataagaagcagtgcagacagactttgaatttcaatttagttttacttccattatattgcaaatgccttcaaaagctatgctaatctgttattttaaactgctttattac

SEQ ID NO: 108688 - DNA, 201 bp, Bos taurus; identical to SEQ ID NO: 27684

SEQ ID NO: 108689 - DNA, 201 bp, Bos taurus; identical to SEQ ID NO: 27685

SEQ ID NO: 108690 - DNA, 201 bp, Bos taurus; identical to SEQ ID NO: 27686

SEQ ID NO: 108691 - DNA, 201 bp, Bos taurus; identical to SEQ ID NO: 27687

SEQ ID NO: 108692 - DNA, 201 bp, Bos taurus; identical to SEQ ID NO: 27688

SEQ ID NO: 108693 - DNA, 201 bp, Bos taurus; identical to SEQ ID NO: 27690

SEQ ID NO: 108694 - DNA, 201 bp, Bos taurus; identical to SEQ ID NO: 27691

SEQ ID NO: 108695 - DNA, 201 bp, Bos taurus; identical to SEQ ID NO: 27692

SEQ ID NO: 108696 - DNA, 201 bp, Bos taurus; identical to SEQ ID NO: 27693

SEQ ID NO: 108697 - DNA, 201 bp, Bos taurus; identical to SEQ ID NO: 27694

SEQ ID NO: 108698 - DNA, 201 bp, Bos taurus; identical to SEQ ID NO: 27695

SEQ ID NO: 108699 - DNA, 201 bp, Bos taurus; identical to SEQ ID NO: 27696

SEQ ID NO: 108700 - DNA, 201 bp, Bos taurus
ttgtctcagactgcatagataatgaaaaatggcctgcttacactgcaagagtagcaaaaagatatgtttgtttgtgtgtgtgtgtgtgtgtcttgtcttttgggccagaaaagaagtagaatgactaacgcaaacactgaacaaaattaatacatatttttatcatccttaatttctaacaaattgcaagaaatgactgga

SEQ ID NO: 108701 - DNA, 201 bp, Bos taurus; identical to SEQ ID NO: 27697

SEQ ID NO: 108702 - DNA, 201 bp, Bos taurus
tctatccaatatatcttgcataatccaacatatgtaactttcaacacagtaggcaagactcacaaaataaacattaatatcctctcaaattagagactgcttgttattagactacaaggtttgattgttttttatttttccttgccccctgttcttacagttaagagttgggtagttgctggttttatgtaatagcaattc

SEQ ID NO: 108703 - DNA, 201 bp, Bos taurus
agatgttccatcaaaagaaaatttaaaatatagatatgaatgcaaatgatatatttccttctaatattgtaatgagttatattgtaaaatttattgtacaatattgttattgttatattgtaaagaacacttgattgtaaagaacactttaaatattgttatattgtaaagttatattgtaaacaacacttgagtagaaaa

SEQ ID NO: 108704 - DNA, 201 bp, Bos taurus
gggaaaggctacccactccagtattctggccaggagaattccatagactatatagtccatggggtctcaaagagtcccacacaactcaaagactttcactttcaactcaatcttaagagtcagggaagagtgtctgtataaacagtcccaatataggtttcaactccatgtgattctttatcttcctgctcatctctggct

SEQ ID NO: 108705 - DNA, 201 bp, Bos taurus
ctgtcagtctacattgggaactgggatgttactaattctgtaaagcacatttagtcctgtgaaaagtggtatacaaataaaatgattgatgtcctgtcaataggaacttcacgaagaggatcaaacagagcagtttcttttgaagaagggatggaggttaggggaaaggtgttagattttacttttctatcataaacccca

SEQ ID NO: 108706 - DNA, 201 bp, Bos taurus
aagaatctgataattcagttccaccccaggcctatgctaatattcagccaattgtggaatgccttgacctctgtggaagatgcattcgggttctgtgcagcatcagattgggagtttgggcccagatacaatttttattagaaattgagagtcaggcataataaggaggggggattttgatcacaaaagaaatgtatagga

SEQ ID NO: 108707 - DNA, 201 bp, Bos taurus
actcttgagtaaagacctaagagtagaacagtctgaatcatatgtttatatgttttgttaagaaactatcaactatttttagagtgtttatagtagtcatcattttacgttccaccagcagaatgtgacagtaccattttgtcaacattctcttcaatagttgattttaagcatttattttagcctttaattttagttatt

SEQ ID NO: 108708 - DNA, 201 bp, Bos taurus; identical to SEQ ID NO: 27699

SEQ ID NO: 108709 - DNA, 201 bp, Bos taurus
ggcatgcgctgcaattaagtaaatgaatgaatgaagtacattgggatctcagttgactgtgttatctacttcaagaattgctgggagtaggaaaaagcacacaaaatgtctcacttactcctccctgttggccccattgttcccattctgccctctttgtttgtacgtagaagaaggctagcatcaggaatgtttcacgca

SEQ ID NO: 108710 - DNA, 201 bp, Bos taurus
ggtggttgtacaatttaaaaaccagagacttttacctctaaacttcgattatctacaccccggccccattgttgactttgtcatcacctgaaaattctgtatgtcaggaatccttatcactggctacaagcagaagcccagtagctatgtcactggtgggtcccagaattcagtgagaaatgtagaggctgccctgctgag

SEQ ID NO: 108711 - DNA, 201 bp, Bos taurus; identical to SEQ ID NO: 27700

SEQ ID NO: 108712 - DNA, 201 bp, Bos taurus; identical to SEQ ID NO: 27701

SEQ ID NO: 108713 - DNA, 201 bp, Bos taurus; identical to SEQ ID NO: 27702

SEQ ID NO: 108714 - DNA, 201 bp, Bos taurus; identical to SEQ ID NO: 67645

SEQ ID NO: 108715 - DNA, 201 bp, Bos taurus; identical to SEQ ID NO: 27703

SEQ ID NO: 108716 - DNA, 201 bp, Bos taurus; identical to SEQ ID NO: 27704

SEQ ID NO: 108717 - DNA, 201 bp, Bos taurus
gttattcacattgtctctctgacccaacctcagaagtttttgatcgtttctttgttttctggtatgaaaacatatcccagttcatagtaaatattttctgtcacagatctgaaacctaataatcctattttctttcagtgggattggttattttgagaatattatgtgacttgtagatgtgctcatagctagtggtttagt

SEQ ID NO: 108718 - DNA, 201 bp, Bos taurus
ccgtcaatctagggtaataaaacaattcaaggttttacttaatcccaggcatccaaagttaccagtgactgttggctcaacaaaaacaagttatttggagctgggacagatgagaaggaatctgtgttgagggtagcatttctcagagtgctcagctttcaaatccttgagaatatcctctctaaatctcccttgcttttt

SEQ ID NO: 108719 - DNA, 201 bp, Bos taurus
agaggaaagaaatatataggatagctcatacaaagatattaatagagaatattttatgtgtcataaaatagacaatttattttcactacaaataagttcttaattcattggcatatggtttttgaaatctatagtgaatattacctcatccttaaaatttgcttttaacataaagctagaagaacaaggtatcttagacaa

SEQ ID NO: 108720 - DNA, 201 bp, Bos taurus; identical to SEQ ID NO: 27705

SEQ ID NO: 108721 - DNA, 201 bp, Bos taurus; identical to SEQ ID NO: 27706

SEQ ID NO: 108722 - DNA, 201 bp, Bos taurus
aaggcctggtgaagtacagtttggtcctgctgataaagggaactagctagggggagagccttttccactgagtaggaggtatatctggtgagagaagcagaacttatggttataggccttagggaccccgtgaggctccaagatgtcaaagcagcatttaatattgcaagttaatgtcaagcctcccattacaacatgaaa

SEQ ID NO: 108723 - DNA, 201 bp, Bos taurus
gctttcagtggctttaattttcaatggtaagcacagcttctatatagtgttgtcaaaaccgcaatgaagtcatgtcattgaatattaaaggcccggcccgtggaatgccaacacagagatttgaatttcatgctcgctcctaaacatcaagacaaatatgtctaatttcataaaaacccggccagccccagggaggctgac

SEQ ID NO: 108724 - DNA, 201 bp, Bos taurus; identical to SEQ ID NO: 27707

SEQ ID NO: 108725 - DNA, 201 bp, Bos taurus; identical to SEQ ID NO: 27708

SEQ ID NO: 108726 - DNA, 201 bp, Bos taurus
gcccacaggcccacttcagccctgcctgtcacaaggtgtgaaggaccctggaggcaggacccaaggtgggtggaggggcccaaatgactgggaccctgcctagctcctttccctgtcttctgtgggaagtggaggtgccgggcattgtctaaagatggaagggagccagttaacctctgtcaggccgtgtcttgggcacat

SEQ ID NO: 108727 - DNA, 201 bp, Bos taurus
aaaaggaagtggccctgcgccccagccatgaaccccccacatagggaaacttggagcctgggggcccacgtctggtctctccaccagcccgggcccccgcttgtctcagtctctctctggcaggacgaaggttggggcaagtgtgacagcccgtccgtgagacgttcatttccactccgtgcagagcaggtgcaggccagt

SEQ ID NO: 108728 - DNA, 201 bp, Bos taurus; identical to SEQ ID NO: 27709

SEQ ID NO: 108729 - DNA, 201 bp, Bos taurus; identical to SEQ ID NO: 27710

SEQ ID NO: 108730 - DNA, 201 bp, Bos taurus; identical to SEQ ID NO: 27711

SEQ ID NO: 108731 - DNA, 201 bp, Bos taurus; identical to SEQ ID NO: 27712

SEQ ID NO: 108732 - DNA, 201 bp, Bos taurus; identical to SEQ ID NO: 27713

SEQ ID NO: 108733 - DNA, 201 bp, Bos taurus
taacagatttttacctttcaaatgaaatatttcaggaaaatgcctacagtgattggaagttgttgcactgtttaatcttggccagcctggggaccagctgggatgtgaaggaattaaatgcagggctttagattgagaaaacctgagtatggccagtcagttaacctctctgagcctcagtttacctgcttgtaaaatgga

SEQ ID NO: 108734 - DNA, 201 bp, Bos taurus
cacataggccacagagaagagggaaagcaaagaataagatgatatgaaagaaaggaagcagcagagaagggagaaaaagcccagcaggagagaggagagatgcagcaggcagcgggccctgctcaggagggaaggaagctgccccagacctcgggatcctccaggagacaggccccgtgctctggcttcagccctgcgtca

SEQ ID NO: 108735 - DNA, 201 bp, Bos taurus
taacccctaatatttcagtgcatagatatgctgtaattttaaccactctccttttcttagatttcttctaactccccatcacaaataatgctgtacagaatatttttatgtgcacagtatctctttcatttttagagctacttacgatatgtaccagagaaggcaatggcaccccactccagtactcttgcctggaaaatc

SEQ ID NO: 108736 - DNA, 201 bp, Bos taurus
ccctcgccacttgaaccagtgtctggcttcgtttatctttgacatcaagtctagcctcagggactcatctttcttggggccgttccccactgcaaccactcctcttccccacctcaactgagaagacagggctgacccccctcacacacaccccacgggccagtccgtcctctccttctcccagagctcctcttcgtcctg

SEQ ID NO: 108737 - DNA, 201 bp, Bos taurus; identical to SEQ ID NO: 27714

SEQ ID NO: 108738 - DNA, 201 bp, Bos taurus; identical to SEQ ID NO: 27715

SEQ ID NO: 108739 - DNA, 201 bp, Bos taurus
aggacgtgcctgttctgaattgatggcctgaggcagagctcaactttaatgtgtgtgtgagtcacctggagatctagttaaaatccaggttctaatccattcactctggggtgtggcctgagatcatgcatttctaaatagctcccaggggatgcagtgctgttttcatgagaacagattatactgtgtgacctgagggac

SEQ ID NO: 108740 - DNA, 201 bp, Bos taurus
accaccaaccaatcagaagacagtcccacacctgcatccttcactccagatttcgcctataaaaactcttccatcaaggccatgtgagagtttgagtcttggcagcatgaactgcctgctctccctgcctgaccctgcagtaagcctctgtctgctccagactccaacattttggtttgtttggcctcactgtgcatcgga

SEQ ID NO: 108741 - DNA, 201 bp, Bos taurus
caggatcctatggaatgactaatttgtgtgggggcccagcatacatgaaacctcggtgcctgcaagagtgatgtttctatttcccccagtcctgtggaacccccacagtcaaaacccactggccttcaaagccaaatattctagagattccccctccctatgccagtccctcaggctgtggagcctgatgtgtggggctca

SEQ ID NO: 108742 - DNA, 201 bp, Bos taurus
tctgagccccaggttccttatcgatgaaatggggagacatacttctcaaggtgtgaagaaacattaagacagtgtgcagagagcacggccagctcagagttgctcgctgtcggaacgttccacagcgttctgagcagctgtggacggtctggcagccctgagagccgaaggtccccacacataccactgctcccaaggcct

SEQ ID NO: 108743 - DNA, 201 bp, Bos taurus
ggggaattggtctgagttaggaaaaggcaaaaggatatttcaggtggacaaaacaatatgagttaaaatagggagacagaaaaatcaagggacttctggggacaatgaacagaaaaatggggagatgtggttgtgtgtttggaaaagggaaatctcattctacttcatgtctcaagtagaatgagtataagaaagagactt

SEQ ID NO: 108744 - DNA, 201 bp, Bos taurus; identical to SEQ ID NO: 27717

SEQ ID NO: 108745 - DNA, 201 bp, Bos taurus; identical to SEQ ID NO: 27718

SEQ ID NO: 108746 - DNA, 201 bp, Bos taurus; identical to SEQ ID NO: 27719

SEQ ID NO: 108747 - DNA, 201 bp, Bos taurus; identical to SEQ ID NO: 27721

SEQ ID NO: 108748 - DNA, 201 bp, Bos taurus
tctgtctaaaaggtatagcatttttcattcatactgtatactggtgtccatgtattaaagtgaaacagagagttagggcaatcatttagatgattcagggaaaaaaaaccacaagtctccagttacccagacagttctgggtaaatttatttttgctacaaaatattcagaaagttacttgatctgtatatatccatgcaa

SEQ ID NO: 108749 - DNA, 201 bp, Bos taurus
caagtgattcaagaacagaggtatacttatgcttagtcaatttccttgtgccctgtggcccacccaagggcatagaatcccagagtatttatgggggacttgttccaggatacccccatcctgcagatgccagcatccatggatactcaaagtcccctccagttgagcctcagtatccacagattctgaatctcctgatat

SEQ ID NO: 108750 - DNA, 201 bp, Bos taurus; identical to SEQ ID NO: 27722

SEQ ID NO: 108751 - DNA, 201 bp, Bos taurus; identical to SEQ ID NO: 27723

SEQ ID NO: 108752 - DNA, 201 bp, Bos taurus
ggaggggcatggcaactcactccagtattcctgcctggagaatcccatggatagtgggctacaattcatggcactgcaaagtgtcagacactattgaagcgactcagcacacatgcacacatctgattaattgctgttctttgggaggggatggaggccaccattttggtgacttcactctgcctaattcttcccaaagtc

SEQ ID NO: 108753 - DNA, 201 bp, Bos taurus
attgcaaatattttagaaaaagtgtcaggaacttttctcagcattttgcattcagcatacatatactcaccacggtcctatgatgtaggcactgttatgattctcattttcagaggtgaacatttctaagcaaaatttcccaagagcacacaacccattaagggttacatgctgggctgtgagttcagtccacgtgggtcc

SEQ ID NO: 108754 - DNA, 201 bp, Bos taurus; identical to SEQ ID NO: 27724

SEQ ID NO: 108755 - DNA, 201 bp, Bos taurus
gtatatttttaatactaagttgacattgactgacatgcaaggaaataagcatacacatcattgcttggggacaaacccaacttggtaaagactcattttggattgtttggcaatgtctgtgcttagatcccatagttaatttctaggaattttgtctaagcaaattatgaggaatatgttgaaggatttttgtataaggct

SEQ ID NO: 108756 - DNA, 201 bp, Bos taurus
aaacctagctacagagagaggctgtccagtttggggctaatagtgatttctctttgaaatagaaagatttaactgtgggcctgaaacacaaagggggtgtggaggcagctggtaggaatgaactttccctgaggcactgagaagagtgtgctgaagattattatctttcaagatggaaatgatcataccgctcagaaaccc

SEQ ID NO: 108757 - DNA, 201 bp, Bos taurus; identical to SEQ ID NO: 27725

SEQ ID NO: 108758 - DNA, 201 bp, Bos taurus; identical to SEQ ID NO: 27726

SEQ ID NO: 108759 - DNA, 201 bp, Bos taurus; identical to SEQ ID NO: 27727

SEQ ID NO: 108760 - DNA, 201 bp, Bos taurus
tttgaatatgctatctaggttggtcataactttccttccaaggagggcatttaaattattattattattgttattttggctgttctctgaaatcttagttgccccaccagggatcaaaagctgtattgggatcttggagtcttaaccactagacttccacagaagtctcaagcctttttgaataggatcagtctcgagaag

SEQ ID NO: 108761 - DNA, 201 bp, Bos taurus; identical to SEQ ID NO: 27728

SEQ ID NO: 108762 - DNA, 201 bp, Bos taurus; identical to SEQ ID NO: 27729

SEQ ID NO: 108763 - DNA, 201 bp, Bos taurus; identical to SEQ ID NO: 27730

SEQ ID NO: 108764 - DNA, 201 bp, Bos taurus; identical to SEQ ID NO: 27731

SEQ ID NO: 108765 - DNA, 201 bp, Bos taurus; identical to SEQ ID NO: 27732

SEQ ID NO: 108766 - DNA, 201 bp, Bos taurus; identical to SEQ ID NO: 27733

SEQ ID NO: 108767 - DNA, 201 bp, Bos taurus; identical to SEQ ID NO: 27734

SEQ ID NO: 108768 - DNA, 201 bp, Bos taurus; identical to SEQ ID NO: 27735

SEQ ID NO: 108769 - DNA, 201 bp, Bos taurus; identical to SEQ ID NO: 27736

SEQ ID NO: 108770 - DNA, 201 bp, Bos taurus; identical to SEQ ID NO: 27737

SEQ ID NO: 108771 - DNA, 201 bp, Bos taurus; identical to SEQ ID NO: 27738

SEQ ID NO: 108772 - DNA, 201 bp, Bos taurus; identical to SEQ ID NO: 27739

SEQ ID NO: 108773 - DNA, 201 bp, Bos taurus; identical to SEQ ID NO: 27740

SEQ ID NO: 108774 - DNA, 201 bp, Bos taurus; identical to SEQ ID NO: 27741

SEQ ID NO: 108775 - DNA, 201 bp, Bos taurus; identical to SEQ ID NO: 27746

SEQ ID NO: 108776 - DNA, 201 bp, Bos taurus; identical to SEQ ID NO: 27747

SEQ ID NO: 108777 - DNA, 201 bp, Bos taurus; identical to SEQ ID NO: 27748

SEQ ID NO: 108778 - DNA, 201 bp, Bos taurus; identical to SEQ ID NO: 27749

SEQ ID NO: 108779 - DNA, 201 bp, Bos taurus; identical to SEQ ID NO: 27750

SEQ ID NO: 108780 - DNA, 201 bp, Bos taurus; identical to SEQ ID NO: 27751

SEQ ID NO: 108781 - DNA, 201 bp, Bos taurus; identical to SEQ ID NO: 27752

SEQ ID NO: 108782 - DNA, 201 bp, Bos taurus; identical to SEQ ID NO: 27753

SEQ ID NO: 108783 - DNA, 201 bp, Bos taurus; identical to SEQ ID NO: 27754

SEQ ID NO: 108784 - DNA, 201 bp, Bos taurus; identical to SEQ ID NO: 27755

SEQ ID NO: 108785 - DNA, 201 bp, Bos taurus; identical to SEQ ID NO: 27756

SEQ ID NO: 108786 - DNA, 201 bp, Bos taurus; identical to SEQ ID NO: 27760

SEQ ID NO: 108787 - DNA, 201 bp, Bos taurus; identical to SEQ ID NO: 27762

SEQ ID NO: 108788 - DNA, 201 bp, Bos taurus
tctgccgtccatttcggagttctccatgcctcctctcaaggctgctcttgatggccacttctaatgctattaaaaatgttaggggatgagaacactcagtggtttgccccgggcccctcttcaggctctgagagcaccagtatttcaccttgattgcatttgttccatgataatattggatgagtttgttaattttctatt

SEQ ID NO: 108789 - DNA, 201 bp, Bos taurus; identical to SEQ ID NO: 27763

SEQ ID NO: 108790 - DNA, 201 bp, Bos taurus; identical to SEQ ID NO: 27764

SEQ ID NO: 108791 - DNA, 201 bp, Bos taurus; identical to SEQ ID NO: 27765

SEQ ID NO: 108792 - DNA, 201 bp, Bos taurus; identical to SEQ ID NO: 27766

SEQ ID NO: 108793 - DNA, 201 bp, Bos taurus
agaagcctgagccctgcaataaagagaggctgccactcactgcaactagagaaagccacagaaaacaacaaagacccagtgcagccaaaaaaagaaaaaaccaacacttttcccttatctcctgcttatgagaacctggagtaatgttctacttttcttccacaaagagatgaatattcttagactttcaagagtgtttta

SEQ ID NO: 108794 - DNA, 201 bp, Bos taurus
gttcatagggtcccacagagtcagacatgactgaagtgacttagcaaacatggagagtaacattacatgagcaatctgagcacaagacaatccagataaccacatcaaagcaagtctttgatttctctacaaacaaatagggcgtgcatgtgcacaaatgcaggtgtgcatgtgtatgagcatatgtggtttttagtgaca

SEQ ID NO: 108795 - DNA, 201 bp, Bos taurus; identical to SEQ ID NO: 27768

SEQ ID NO: 108796 - DNA, 201 bp, Bos taurus; identical to SEQ ID NO: 27769

SEQ ID NO: 108797 - DNA, 201 bp, Bos taurus; identical to SEQ ID NO: 27770

SEQ ID NO: 108798 - DNA, 201 bp, Bos taurus; identical to SEQ ID NO: 27771

SEQ ID NO: 108799 - DNA, 201 bp, Bos taurus; identical to SEQ ID NO: 27772

SEQ ID NO: 108800 - DNA, 201 bp, Bos taurus; identical to SEQ ID NO: 27773

SEQ ID NO: 108801 - DNA, 201 bp, Bos taurus
accaacacaacattgtaaagcaactatcttccaattaaaaaaaaaaaagcctaaaaaaaaaaaaaaaagatctcaagaggccctatctctaacctaaatgcgcactgaaaagaaaaaaagattttctgcaagcaaattcgtcaactgaacgctatgagttttcataaactgacttgggagcttaaaggccttgcaataagc

SEQ ID NO: 108802 - DNA, 201 bp, Bos taurus
cgaaatttggaaggcaaaaatgctggctgaggcctacacgctgctgaaaaggccagccaattatgtaattcagtgaacataggccttcaggagggttctcgtccgaggaattcagcaggctaaccaacagagtctgctctgggcacatgccagggtcaggcactcaacgtgctatagtgcagaatcccgcattcccactct

SEQ ID NO: 108803 - DNA, 201 bp, Bos taurus
tgcttaatttacagctaatttcctcaaaggtaaaaaaaggaaaattcatataatttcaattttttgcataaagggggattttattaatatttcttattgtactattccaactctgcataattcacacttatttgcactaattactgcagtgatatacataaggggcttaaataactgagcagttatagctgctaccttggc

SEQ ID NO: 108804 - DNA, 201 bp, Bos taurus
gcaggcaggttctttacctctgagccacctgggaaatcaggaacccaggtggatccccaagtagcaaaaccattacaaagatgtgcaaagacaaaccactgcaccagcagcttctgctgggtttcctaggtgccaagatgctctctaagctgagccccctctagctcatcacgcccagcaaatctgattaaaatggattag

SEQ ID NO: 108805 - DNA, 201 bp, Bos taurus; identical to SEQ ID NO: 27775

SEQ ID NO: 108806 - DNA, 201 bp, Bos taurus; identical to SEQ ID NO: 27777

SEQ ID NO: 108807 - DNA, 201 bp, Bos taurus; identical to SEQ ID NO: 27779

SEQ ID NO: 108808 - DNA, 201 bp, Bos taurus; identical to SEQ ID NO: 27780

SEQ ID NO: 108809 - DNA, 201 bp, Bos taurus; identical to SEQ ID NO: 27781

SEQ ID NO: 108810 - DNA, 201 bp, Bos taurus; identical to SEQ ID NO: 27782

SEQ ID NO: 108811 - DNA, 201 bp, Bos taurus; identical to SEQ ID NO: 27783

SEQ ID NO: 108812 - DNA, 201 bp, Bos taurus; identical to SEQ ID NO: 27784

SEQ ID NO: 108813 - DNA, 201 bp, Bos taurus; identical to SEQ ID NO: 27785

SEQ ID NO: 108814 - DNA, 201 bp, Bos taurus; identical to SEQ ID NO: 27786

SEQ ID NO: 108815 - DNA, 201 bp, Bos taurus; identical to SEQ ID NO: 27787

SEQ ID NO: 108816 - DNA, 201 bp, Bos taurus; identical to SEQ ID NO: 27788

SEQ ID NO: 108817 - DNA, 201 bp, Bos taurus; identical to SEQ ID NO: 27789

SEQ ID NO: 108818 - DNA, 201 bp, Bos taurus; identical to SEQ ID NO: 27790

SEQ ID NO: 108819 - DNA, 201 bp, Bos taurus; identical to SEQ ID NO: 27792

SEQ ID NO: 108820 - DNA, 201 bp, Bos taurus
ccttaaaagagatgcacagtctcaaatcctcatgaaaacgacagtaccaactactctgaactattcatatgtgtgagaatgaatcttgggtatctgcctctaagctgatatcatttaaacaacattctgattggtacccatcctgcggatcaaaactctgtggtaccaaaccacttacaaaaagtaaaatatttttaccca

SEQ ID NO: 108821 - DNA, 201 bp, Bos taurus; identical to SEQ ID NO: 27793

SEQ ID NO: 108822 - DNA, 201 bp, Bos taurus; identical to SEQ ID NO: 27794

SEQ ID NO: 108823 - DNA, 201 bp, Bos taurus; identical to SEQ ID NO: 27795

SEQ ID NO: 108824 - DNA, 201 bp, Bos taurus
tggaagggccagactccggcccctagatataacaatagggcttaaacgagttacctgagtataaatttggtgaaagaggtcatggaaagtcagattcagggtgatccttaggctgcctacttggcccagctggacaaaccaaggtcaattgctccaaattttatgaaccccagccaactctatgattttatcaggacacta

SEQ ID NO: 108825 - DNA, 201 bp, Bos taurus; identical to SEQ ID NO: 27797

SEQ ID NO: 108826 - DNA, 201 bp, Bos taurus; identical to SEQ ID NO: 27798

SEQ ID NO: 108827 - DNA, 201 bp, Bos taurus; identical to SEQ ID NO: 27799

SEQ ID NO: 108828 - DNA, 201 bp, Bos taurus; identical to SEQ ID NO: 27802

SEQ ID NO: 108829 - DNA, 201 bp, Bos taurus
gcattaaatttattgtgcactttacttctcttattattacatcagctctacctcagatcacaggcactagatcctagaaattgggggccctgacctaacccgctctgtatccacctgcattttatcccaggagccccagccgcacggcttccccgcccttggatcctcacttgtctgcccggcagtggcctcctgccctac

SEQ ID NO: 108830 - DNA, 201 bp, Bos taurus
gataaagcagcgttgcttcttcaccattttgtggtgcccttaccaatgattgttatcgattttttcggggaaccagaacacctgcatgatggccacatttcggggaatcagaacacctccaggatggccacactctcaagggtgttatgggggcctccaagcactccggtagcttttcagcatttgtaagaagacttcgcc

SEQ ID NO: 108831 - DNA, 201 bp, Bos taurus; identical to SEQ ID NO: 27804

SEQ ID NO: 108832 - DNA, 201 bp, Bos taurus
cagcctctgccccttctttcttttgggttcatctgccagggagaaggccacctgctggtctgcatgctgccttgcaatcggggcctctgctgggggcgctggaactcacagcttcacaagtgtccatgcggattaagaggggagtctggtaaggcccaccggctgcagtcctgagtggattccactcactgaggctagtgg

SEQ ID NO: 108833 - DNA, 201 bp, Bos taurus
atatgtgcacttgtagctgattcatatggatgtatggcaaaaaccactacaatatcgtaaatagccaccaattaaaataaattaattaatttgttaaaaggcaaaaaaagaagggttgggaggaaaggtttagaattcttttagaattccagaatgagttagctaattgcccccatagagtaggggaggaaccacagggga

SEQ ID NO: 108834 - DNA, 201 bp, Bos taurus; identical to SEQ ID NO: 27805

SEQ ID NO: 108835 - DNA, 201 bp, Bos taurus; identical to SEQ ID NO: 27807

SEQ ID NO: 108836 - DNA, 201 bp, Bos taurus; identical to SEQ ID NO: 27808

SEQ ID NO: 108837 - DNA, 201 bp, Bos taurus; identical to SEQ ID NO: 27809

SEQ ID NO: 108838 - DNA, 201 bp, Bos taurus
aatgctccaactgtgagattaaaaaataaagtatattttatataacaagtatttcagcgcataaacgttgggacacaactcaagcagatgggactgtgaaggagttggatggctgctcttatgggcagagtcagcatggatggggaccctgcacatggaaatcaggctgcctgggcttcctgctgccttgctgcataggac

SEQ ID NO: 108839 - DNA, 201 bp, Bos taurus
tgttgcaggggccccaagcccaggtgacttcctgggggaacaagtgacacgagtgggtgaagcctcagagaagaggcctctgctcagctccaggtaggaacatgcacccagttttgccagatctgctgagttttcataaaagccccatgtctggaattttcaaagtgaaaatatcctgatccatgtggccaagccattcag

SEQ ID NO: 108840 - DNA, 201 bp, Bos taurus; identical to SEQ ID NO: 27813

SEQ ID NO: 108841 - DNA, 201 bp, Bos taurus; identical to SEQ ID NO: 27815

SEQ ID NO: 108842 - DNA, 201 bp, Bos taurus; identical to SEQ ID NO: 27816

SEQ ID NO: 108843 - DNA, 201 bp, Bos taurus; identical to SEQ ID NO: 27817

SEQ ID NO: 108844 - DNA, 201 bp, Bos taurus
ttaaacagcactgagcatacaaaaataaatttggggataaataaagcttatttactcaataaaaggttcaccctatcattctaatcaagagaagtcccttcaaaactggacatacttcatgtgcagccttttagaagcacatactgtgtagggagagagggtttgttaggtcgagtgctccctagggcacagctctgactt

SEQ ID NO: 108845 - DNA, 201 bp, Bos taurus; identical to SEQ ID NO: 27818

SEQ ID NO: 108846 - DNA, 201 bp, Bos taurus; identical to SEQ ID NO: 27819

SEQ ID NO: 108847 - DNA, 201 bp, Bos taurus; identical to SEQ ID NO: 27820

SEQ ID NO: 108848 - DNA, 201 bp, Bos taurus
cctttcctagaaatttttaacaaaaatttaaaccaaaaaaaaaaaaaaccacacaaaaaccctgttgaaattaatcaatgaatttagtaaagttgcagtacacaatttaacatataaatatcagtagtgcctccatacactaaaaggaaattttctgaaaaagaaatagagaaataaatctcatttacaacagcatcaaaa

SEQ ID NO: 108849 - DNA, 201 bp, Bos taurus
aagaaaaaaattgcttctttaattaagatttatgggcctcagtagggcccagccagaggagaaaagtggttcaagagagtaaaaactaatggttaaaaatgagacaatatgattacaggcctttaattcctcctgcttcttttgcagagcttccagtggccccaggcaaaagcaggaacttattgtctttaaaatagcatt

SEQ ID NO: 108850 - DNA, 201 bp, Bos taurus; identical to SEQ ID NO: 27822

SEQ ID NO: 108851 - DNA, 201 bp, Bos taurus; identical to SEQ ID NO: 27824

SEQ ID NO: 108852 - DNA, 201 bp, Bos taurus; identical to SEQ ID NO: 27825

SEQ ID NO: 108853 - DNA, 201 bp, Bos taurus; identical to SEQ ID NO: 27826

SEQ ID NO: 108854 - DNA, 201 bp, Bos taurus; identical to SEQ ID NO: 27827

SEQ ID NO: 108855 - DNA, 201 bp, Bos taurus; identical to SEQ ID NO: 27828

SEQ ID NO: 108856 - DNA, 201 bp, Bos taurus; identical to SEQ ID NO: 27829

SEQ ID NO: 108857 - DNA, 201 bp, Bos taurus
ttcaggccaattctaacatcagatggaattctcagatggcctttgaggtcccttccagccccctggatcctttctgtggtggtttggaggggtggtgctcattgtgagtctggtgcccaaaggccagattcagaaaatagtccctgtaagccttgctcttgctcttctgcgtcctgagcacctatttgcagctgctattgg

SEQ ID NO: 108858 - DNA, 201 bp, Bos taurus
cttgcagactcatacctaaaccctgtcggtgagtggaaagtaacaagctgcgtctggtggcaggctttaagtcagaatccaacacttactttagtccatgtgtggcccacgcattattttatttaccacttccacccatgcctctttctcactctgcacacttttctcagtcacagtttcggcaagcccacaagctaaccc

SEQ ID NO: 108859 - DNA, 201 bp, Bos taurus; identical to SEQ ID NO: 27830

SEQ ID NO: 108860 - DNA, 201 bp, Bos taurus; identical to SEQ ID NO: 27831

SEQ ID NO: 108861 - DNA, 201 bp, Bos taurus
atctcagtaccccagacccctaggctggggccaggggttcagttgtgcaaatcctgaccccagaagggcaaatgggacaggaccgcaggcaattctgcgcggtggcgctgggggaaggccgccggcaggaaagacaccgagctgccttctcaacactgtgacacagattaaggggttcatggtggaattgggggaatgaaa

SEQ ID NO: 108862 - DNA, 201 bp, Bos taurus; identical to SEQ ID NO: 27832

SEQ ID NO: 108863 - DNA, 201 bp, Bos taurus; identical to SEQ ID NO: 27833

SEQ ID NO: 108864 - DNA, 201 bp, Bos taurus; identical to SEQ ID NO: 27834

SEQ ID NO: 108865 - DNA, 201 bp, Bos taurus
agatgtccactggacttaagctggtggacaaacagcagctcagctgcaaatgaaaagaacaaaagagcattataatctcctgaactgctaagcaaataaaagaagaggacagtctgtcaacacacagaaccatcaactacccaccctcacggacggctccttcagtgagacaaccatcgtgataaagtggccatgactgag

SEQ ID NO: 108866 - DNA, 201 bp, Bos taurus; identical to SEQ ID NO: 27836

SEQ ID NO: 108867 - DNA, 201 bp, Bos taurus; identical to SEQ ID NO: 27837

SEQ ID NO: 108868 - DNA, 201 bp, Bos taurus; identical to SEQ ID NO: 27839

SEQ ID NO: 108869 - DNA, 201 bp, Bos taurus; identical to SEQ ID NO: 27844

SEQ ID NO: 108870 - DNA, 201 bp, Bos taurus; identical to SEQ ID NO: 27849

SEQ ID NO: 108871 - DNA, 201 bp, Bos taurus
tcaagcttcgctctggggaagagaccctcaccccaagggctccttctcctgacatctatcaggcatcttaagccattaacctccagcacctctttgaaagtgtgtttttctacaaaaactttggcttgaggatagagagagagagaattatatttgctcgaatacaatgctttaaaaataaatacagttggggccctgttt

SEQ ID NO: 108872 - DNA, 201 bp, Bos taurus
tctgagggaatttttgaggcccagatttaaagtacattctcctgggaagatttgctttcccaaaatgagtccatattaaaccaagtttttgttaagatgcgtttggtccatgcaggcctcatgtgcttagtccctaaccccatggactgtagcccgccaggctcctctgtccatgggattctccaggcaagaatactggcg

SEQ ID NO: 108873 - DNA, 201 bp, Bos taurus; identical to SEQ ID NO: 27850

SEQ ID NO: 108874 - DNA, 201 bp, Bos taurus; identical to SEQ ID NO: 27851

SEQ ID NO: 108875 - DNA, 201 bp, Bos taurus; identical to SEQ ID NO: 27854

SEQ ID NO: 108876 - DNA, 201 bp, Bos taurus; identical to SEQ ID NO: 27856

SEQ ID NO: 108877 - DNA, 201 bp, Bos taurus; identical to SEQ ID NO: 27857

SEQ ID NO: 108878 - DNA, 201 bp, Bos taurus; identical to SEQ ID NO: 27859

SEQ ID NO: 108879 - DNA, 201 bp, Bos taurus; identical to SEQ ID NO: 27861

SEQ ID NO: 108880 - DNA, 201 bp, Bos taurus
taaaatgctaagggaaaactaaggcagggtaagagatttatgaattgatggaaagatgttttattggatatactggccaaggaaatcctctcttaaaggatgactttgaagcagggaccagaataaggagaggaataagccgcatggacatctggtgaaagacttttggaggcagagaagatagtgggtcagaggccttga

SEQ ID NO: 108881 - DNA, 201 bp, Bos taurus; identical to SEQ ID NO: 27863

SEQ ID NO: 108882 - DNA, 201 bp, Bos taurus; identical to SEQ ID NO: 27864

SEQ ID NO: 108883 - DNA, 201 bp, Bos taurus; identical to SEQ ID NO: 27867

SEQ ID NO: 108884 - DNA, 201 bp, Bos taurus; identical to SEQ ID NO: 27873

SEQ ID NO: 108885 - DNA, 201 bp, Bos taurus; identical to SEQ ID NO: 27874

SEQ ID NO: 108886 - DNA, 201 bp, Bos taurus
ttcacatctctgcaaatggcactgtttcgttcccttttacggccgagtgatattcccctgtgtgtgtggagcacttcctctttatccattccactgttgatggacatttaggttgcggccacatcctagctattgtaaatagcgctgccatgaacactgaggtgcatgcatcctttcgaattccagtttctcaggatatat

SEQ ID NO: 108887 - DNA, 201 bp, Bos taurus
ttgtaaggtttccaagcatctcaaaaaaagattctttagattacaagtgatgcctaagtctagagcgcttctgacaggcaaagtttcgttacattcggtatcctgtttccttgatttttgttgctgggagggattgaggcaggagaaaaaggggacgacagaggatgagatggctggatggcatcaccaactcgatggacg

SEQ ID NO: 108888 - DNA, 201 bp, Bos taurus; identical to SEQ ID NO: 27877

SEQ ID NO: 108889 - DNA, 201 bp, Bos taurus
tagtgttgtgtctcataattctgtgggccaggaattcagacagggagctaacagcaagagtgacttgtgtctgctgcagaatgtctgggcacacagctggtggctgtgggcctctctcgcctttcctctctgtgcatgtctatggcgcggcgtctccggggaaccactgttcctataggcctggggtcccagagcaagtgt

SEQ ID NO: 108890 - DNA, 201 bp, Bos taurus
ttgcaggggaaggtaaacaggccgtcagcacagaccgaggatccgagagacagacgtgtggggacttggtgtgtgaaaggtggtgtttcagagaaccatcgaagtgtgtgtgagcagtggtaccggctggctttccagttgggaaaaattatataattagatccctacttctgtcgcgcacagaacgtttcaagtgaatag

SEQ ID NO: 108891 - DNA, 201 bp, Bos taurus
tctgtcattatttgtttaagtctgaaagctgttttaaataaacacatgctcattttatgtattaaaagcaacaaagagggaagaagaaaacctgggccattgtcatgtgatctggacaaaccccccgcctatatgttcagggtgcactcagcccctggttgtgtcgggactggccagggctctgcccgacctcagggatgg

SEQ ID NO: 108892 - DNA, 201 bp, Bos taurus; identical to SEQ ID NO: 27880

SEQ ID NO: 108893 - DNA, 201 bp, Bos taurus; identical to SEQ ID NO: 27881

SEQ ID NO: 108894 - DNA, 201 bp, Bos taurus; identical to SEQ ID NO: 27882

SEQ ID NO: 108895 - DNA, 201 bp, Bos taurus; identical to SEQ ID NO: 27884

SEQ ID NO: 108896 - DNA, 201 bp, Bos taurus; identical to SEQ ID NO: 27885

SEQ ID NO: 108897 - DNA, 201 bp, Bos taurus
tgtccatcctggaggaggacaaggactggcggccagccatcaccatcaagcaggtatgcgcccatgcccaccctccccagtggagcccagcccgcggccggagagcctgcccttcccaccactctgttctctctcatgcagatcttattaggaatacaggaacttctaaacgaaccaaatatccaagacccagctcaagca

SEQ ID NO: 108898 - DNA, 201 bp, Bos taurus; identical to SEQ ID NO: 27888

SEQ ID NO: 108899 - DNA, 201 bp, Bos taurus; identical to SEQ ID NO: 27889

SEQ ID NO: 108900 - DNA, 201 bp, Bos taurus; identical to SEQ ID NO: 27890

SEQ ID NO: 108901 - DNA, 201 bp, Bos taurus; identical to SEQ ID NO: 27892

SEQ ID NO: 108902 - DNA, 201 bp, Bos taurus; identical to SEQ ID NO: 27893

SEQ ID NO: 108903 - DNA, 201 bp, Bos taurus; identical to SEQ ID NO: 27894

SEQ ID NO: 108904 - DNA, 201 bp, Bos taurus
gggttctctttaaagtgatttgctcagctctgggggcttggggaccttctgtagagaggcactgtctcatttttctgtctcatataatcaggtttggttcggaattcaggaggcagtgtgctctaggtcagtttgagctcctgcagcttgtcctcaggcagtgtgttgtagcacaggctcacaccacacatacgggtcttc

SEQ ID NO: 108905 - DNA, 201 bp, Bos taurus
acagggatttttattcctctctgtctgcaagttgacagtgactcaagaatgtcaggtttggctcgtggggcagtttagactgcggaagccttccagtcctagggccatgctggggccatgtgaggcgggccaggttccatcgcagagtgcaggggctgtaagagtgtttaatactcatgtgctatttcctgctatttcgtt

SEQ ID NO: 108906 - DNA, 201 bp, Bos taurus; identical to SEQ ID NO: 27899

SEQ ID NO: 108907 - DNA, 201 bp, Bos taurus; identical to SEQ ID NO: 27900

SEQ ID NO: 108908 - DNA, 201 bp, Bos taurus; identical to SEQ ID NO: 27902

SEQ ID NO: 108909 - DNA, 201 bp, Bos taurus; identical to SEQ ID NO: 27903

SEQ ID NO: 108910 - DNA, 201 bp, Bos taurus
acgtggctgccacaaaccagtccaattcctctcccatgattcagtgtcattccttgtccagattcatggcccagcgtgggcccgtgaaccagtgttctgacctcttccctcaagttttagcttgagtgtttgttttcctgttgctcagtcactgcccacgatcattgttttcagggtgacacgatacatccacagaatgat

SEQ ID NO: 108911 - DNA, 201 bp, Bos taurus; identical to SEQ ID NO: 27905

SEQ ID NO: 108912 - DNA, 201 bp, Bos taurus
aactggtcatcactgcaggtgttttctggtggtttctggcagagctaagccatagcatttaggaaaggagttgacaacaaggaagacttgccgtttctgatgcccataggggtgagatccgctatcatcccaggggatggttcgatcaggcaaccacttacgtttctgtatcttcatgataatcacatatcttaggaaagc

SEQ ID NO: 108913 - DNA, 201 bp, Bos taurus; identical to SEQ ID NO: 27906

SEQ ID NO: 108914 - DNA, 201 bp, Bos taurus
tcctgtaatctaagaaatgggggcctcacaaaagccttgtgtccaccagccccgcaggggcctgcacgttggatacccaggcaggaggagggccagatttcagccctgtggaaacctggcccaaatctttgtccatttgctctagtagaacagctggggctggacctggggctgggtggaaggagggggagggtgggcttt

SEQ ID NO: 108915 - DNA, 201 bp, Bos taurus; identical to SEQ ID NO: 27908

SEQ ID NO: 108916 - DNA, 201 bp, Bos taurus; identical to SEQ ID NO: 27909

SEQ ID NO: 108917 - DNA, 201 bp, Bos taurus; identical to SEQ ID NO: 27910

SEQ ID NO: 108918 - DNA, 201 bp, Bos taurus; identical to SEQ ID NO: 27911

SEQ ID NO: 108919 - DNA, 201 bp, Bos taurus
gaggggaggagggggagaccagtttccagtggccaaactttcctaattaccttcacagcagctctcgggtccctgggcgactctcctgaaaaagagaaattgcctctggatgcgggccccaagcagggagcaggcctgcgattggcccaagataattgggctgttgtctgggtctcggggaaaggtctgtttgggaacatt

SEQ ID NO: 108920 - DNA, 201 bp, Bos taurus; identical to SEQ ID NO: 27912

SEQ ID NO: 108921 - DNA, 201 bp, Bos taurus; identical to SEQ ID NO: 27913

SEQ ID NO: 108922 - DNA, 201 bp, Bos taurus
caacccatgtcccctgcattaacaggtggatttataaccactggaccaccagtaactccctgctcttggcttttgtgtggggccagttctgtggctcccatttctttggcgctcccattgcacgctcctttatccccgctgcttcctcatggttccttggtaagaactcagttttagagccaaatgggccaaggttaagtc

SEQ ID NO: 108923 - DNA, 201 bp, Bos taurus; identical to SEQ ID NO: 27914

SEQ ID NO: 108924 - DNA, 201 bp, Bos taurus; identical to SEQ ID NO: 27915

SEQ ID NO: 108925 - DNA, 201 bp, Bos taurus; identical to SEQ ID NO: 27916

SEQ ID NO: 108926 - DNA, 201 bp, Bos taurus; identical to SEQ ID NO: 27918

SEQ ID NO: 108927 - DNA, 201 bp, Bos taurus; identical to SEQ ID NO: 27919

SEQ ID NO: 108928 - DNA, 201 bp, Bos taurus; identical to SEQ ID NO: 27921

SEQ ID NO: 108929 - DNA, 201 bp, Bos taurus
atataaagtatatcataataaagctgacgaaagaaaaaaaaaatcaaagaagaaaaaaacaaaaacacaaacaaagatcctgaggccagaaaaagctgattgtggtctggaaactgtcgaggtctgttgtgattggcgaacagtaagtgagaaggagagaggcccaagatatttgatctaatttggttttcagagtagcca

SEQ ID NO: 108930 - DNA, 201 bp, Bos taurus; identical to SEQ ID NO: 27922

SEQ ID NO: 108931 - DNA, 201 bp, Bos taurus; identical to SEQ ID NO: 27923

SEQ ID NO: 108932 - DNA, 201 bp, Bos taurus; identical to SEQ ID NO: 27924

SEQ ID NO: 108933 - DNA, 201 bp, Bos taurus; identical to SEQ ID NO: 27925

SEQ ID NO: 108934 - DNA, 201 bp, Bos taurus; identical to SEQ ID NO: 27926

SEQ ID NO: 108935 - DNA, 201 bp, Bos taurus
attttggagttagagccaggacaagctcatggtctggatgtgggggctgagtgagagggacatgagggcagctttatgcggccattcactaagatggggagctttgttttgggtgggagggggcaccacaggaggagtctgggtgctgcccagggccctgcctcctgccgctgtgtgaccagtggtagcaaatccagaacc

SEQ ID NO: 108936 - DNA, 201 bp, Bos taurus
ctacccagccttgctagatgaaagaagaggggagggttatattgggacaggtgcccttcttcccgtgtcctggttagatgtccacccaggtggtggcccaatgttcaggcttctgatttggaagtcatcagactgtcccctgcagggtcagctggacaggagctctggccaggacctcaccccgtaccccatccagcctgg

SEQ ID NO: 108937 - DNA, 201 bp, Bos taurus; identical to SEQ ID NO: 27929

SEQ ID NO: 108938 - DNA, 201 bp, Bos taurus; identical to SEQ ID NO: 27931

SEQ ID NO: 108939 - DNA, 201 bp, Bos taurus; identical to SEQ ID NO: 27932

SEQ ID NO: 108940 - DNA, 201 bp, Bos taurus; identical to SEQ ID NO: 27933

SEQ ID NO: 108941 - DNA, 201 bp, Bos taurus
tgtgagaataggctgcctcataggggtgagctggtacccccactgctggggtgggtggtccaggcagttctggtggggcatgcaccaaactccagcctgtagaattatgacaactgcctggtaacacaggagcatcttggtgtgttgtgcagtcccagccacgctggctgccatcgatcacagctgagaaataaagctcta

SEQ ID NO: 108942 - DNA, 201 bp, Bos taurus; identical to SEQ ID NO: 27935

SEQ ID NO: 108943 - DNA, 201 bp, Bos taurus; identical to SEQ ID NO: 27936

SEQ ID NO: 108944 - DNA, 201 bp, Bos taurus; identical to SEQ ID NO: 27937

SEQ ID NO: 108945 - DNA, 201 bp, Bos taurus; identical to SEQ ID NO: 27938

SEQ ID NO: 108946 - DNA, 201 bp, Bos taurus; identical to SEQ ID NO: 27940

SEQ ID NO: 108947 - DNA, 201 bp, Bos taurus
gggcctggagatgggatgtgtcccacaggaaagacacaaagaattgccctgctccaaatgctagtagcccccagttgagaaacctgtacattaagaaacagccaggggccatatgagcctgcaatcccactctggccatatatcctgacaaaactgtaattcaaaaaagatacatgcatatattcataggagccctattta

SEQ ID NO: 108948 - DNA, 201 bp, Bos taurus
ggacatctggaccttcctgtctggctaatcctccagccaagggaacccaatcaaaaccaacagaggaatccaaccaagccaatcacaggatcatgaaaagtaatacattgttgttctaagccattatgttctagggcgtgtttgtcatgcagccaaggctcactgagacatgttgtaagaagccaagctgagattcgaacc

SEQ ID NO: 108949 - DNA, 201 bp, Bos taurus
atcaatttttgttttttaaaatttctctgtagtattcatggtgtgctccaacctctgactttcaaaacaaatgaaaagctaattttcctcaagctatttctataacaattataggcagagggataatgccttataatgtatttaaggagtttccctcgtagctcacactataaagaatctgcctgcactgcaggagaaacg

SEQ ID NO: 108950 - DNA, 201 bp, Bos taurus; identical to SEQ ID NO: 27941

SEQ ID NO: 108951 - DNA, 201 bp, Bos taurus; identical to SEQ ID NO: 27942

SEQ ID NO: 108952 - DNA, 201 bp, Bos taurus; identical to SEQ ID NO: 27943

SEQ ID NO: 108953 - DNA, 201 bp, Bos taurus; identical to SEQ ID NO: 27944

SEQ ID NO: 108954 - DNA, 201 bp, Bos taurus; identical to SEQ ID NO: 27945

SEQ ID NO: 108955 - DNA, 201 bp, Bos taurus
aacaacctggtctgggcaagggcccgtggaaggagctgtggagacaagaaggcagctggcaggtggagatgatcagatcaagctgctggtagttttgcccggggtggccctgtcaggtagcttgacaattacgcgcatcctcccctacccccattaaagttaattgagttgttatggagccacagtgagggagtgggagtg

SEQ ID NO: 108956 - DNA, 201 bp, Bos taurus; identical to SEQ ID NO: 27946

SEQ ID NO: 108957 - DNA, 201 bp, Bos taurus; identical to SEQ ID NO: 27948

SEQ ID NO: 108958 - DNA, 201 bp, Bos taurus; identical to SEQ ID NO: 27949

SEQ ID NO: 108959 - DNA, 201 bp, Bos taurus
caactaaatggtttggaatgaaaaaaagattgagaacccaggaggaaatgtttcttcccatgcatgaaagctgaatggcctgggttatagagagttatctatggtcagatctcacttggaaggcgaatgagatccctaagggtagggcacccttaaaagatatttcaacatatccattaagggaggcctataaattctagg

SEQ ID NO: 108960 - DNA, 201 bp, Bos taurus; identical to SEQ ID NO: 27951

SEQ ID NO: 108961 - DNA, 201 bp, Bos taurus; identical to SEQ ID NO: 27952

SEQ ID NO: 108962 - DNA, 201 bp, Bos taurus; identical to SEQ ID NO: 27953

SEQ ID NO: 108963 - DNA, 201 bp, Bos taurus; identical to SEQ ID NO: 27954

SEQ ID NO: 108964 - DNA, 201 bp, Bos taurus; identical to SEQ ID NO: 27956

SEQ ID NO: 108965 - DNA, 201 bp, Bos taurus
taggacatgactgagtgactttcattttcactttacatattcatcataacacacaaaaaagaggtccaggatcaaatagattagggaaacagcaggttaatgagactttaacaaggttttttattgcaggacttctcagagcctttagcacattaacgtgcactcatctatccaaccagcatatagtcagtgtctaccgtg

SEQ ID NO: 108966 - DNA, 201 bp, Bos taurus; identical to SEQ ID NO: 27958

SEQ ID NO: 108967 - DNA, 201 bp, Bos taurus; identical to SEQ ID NO: 27959

SEQ ID NO: 108968 - DNA, 201 bp, Bos taurus; identical to SEQ ID NO: 27960

SEQ ID NO: 108969 - DNA, 201 bp, Bos taurus; identical to SEQ ID NO: 27961

SEQ ID NO: 108970 - DNA, 201 bp, Bos taurus; identical to SEQ ID NO: 27962

SEQ ID NO: 108971 - DNA, 201 bp, Bos taurus; identical to SEQ ID NO: 27963

SEQ ID NO: 108972 - DNA, 201 bp, Bos taurus; identical to SEQ ID NO: 27964

SEQ ID NO: 108973 - DNA, 201 bp, Bos taurus; identical to SEQ ID NO: 27965

SEQ ID NO: 108974 - DNA, 201 bp, Bos taurus; identical to SEQ ID NO: 27966

SEQ ID NO: 108975 - DNA, 201 bp, Bos taurus; identical to SEQ ID NO: 27967

SEQ ID NO: 108976 - DNA, 201 bp, Bos taurus; identical to SEQ ID NO: 27968

SEQ ID NO: 108977 - DNA, 201 bp, Bos taurus; identical to SEQ ID NO: 27969

SEQ ID NO: 108978 - DNA, 201 bp, Bos taurus; identical to SEQ ID NO: 27971

SEQ ID NO: 108979 - DNA, 201 bp, Bos taurus; identical to SEQ ID NO: 27972

SEQ ID NO: 108980 - DNA, 201 bp, Bos taurus; identical to SEQ ID NO: 27973

SEQ ID NO: 108981 - DNA, 201 bp, Bos taurus; identical to SEQ ID NO: 27974

SEQ ID NO: 108982 - DNA, 201 bp, Bos taurus; identical to SEQ ID NO: 27975

SEQ ID NO: 108983 - DNA, 201 bp, Bos taurus; identical to SEQ ID NO: 27976

SEQ ID NO: 108984 - DNA, 201 bp, Bos taurus; identical to SEQ ID NO: 27977

SEQ ID NO: 108985 - DNA, 201 bp, Bos taurus; identical to SEQ ID NO: 27978

SEQ ID NO: 108986 - DNA, 201 bp, Bos taurus; identical to SEQ ID NO: 27979

SEQ ID NO: 108987 - DNA, 201 bp, Bos taurus; identical to SEQ ID NO: 27980

SEQ ID NO: 108988 - DNA, 201 bp, Bos taurus; identical to SEQ ID NO: 27981

SEQ ID NO: 108989 - DNA, 201 bp, Bos taurus; identical to SEQ ID NO: 27982

SEQ ID NO: 108990 - DNA, 201 bp, Bos taurus; identical to SEQ ID NO: 27983

SEQ ID NO: 108991 - DNA, 201 bp, Bos taurus; identical to SEQ ID NO: 27984

SEQ ID NO: 108992 - DNA, 201 bp, Bos taurus; identical to SEQ ID NO: 27985

SEQ ID NO: 108993 - DNA, 201 bp, Bos taurus; identical to SEQ ID NO: 27986

SEQ ID NO: 108994 - DNA, 201 bp, Bos taurus
ctgtgcagggtcttagctgtggtatgcaggatcttcaggaccctttttagtttcggcatgcagaatctttaatttctgcacacaaactcttagatgcagcccgtgagttctagttccctgaccagggatcaaacctgggccctcttcattgagaatgcagagtcttagccactggagcaccagggaagtccctgtgcattc

SEQ ID NO: 108995 - DNA, 201 bp, Bos taurus; identical to SEQ ID NO: 27988

SEQ ID NO: 108996 - DNA, 201 bp, Bos taurus
agaaaagagattactggggctgagagtaggaatgagattgcaaacaggaacaaggggcctttttggaaatgtgcaaaagattaggtggttccaaaactcaacaaacttactaaaactcagtgaactgtatacttctaatggctgatgtaaattatacttcaataaaactgctgaaataaaaataaaaaagaggaaatgggt

SEQ ID NO: 108997 - DNA, 201 bp, Bos taurus
gcatgggccataggtgaatgggacccacgtattaacctcagagcatctgctggacccattttggatgctccctgggaactgagaaaccggagggagccatttttgcaatttcaggccactttgctgatcccagtgcctgtgggtgtcactttggaattctccctctagtctgagcaccagtaagcacaccccacttagaac

SEQ ID NO: 108998 - DNA, 201 bp, Bos taurus
caaggtcgcagcaattcccgtcagctcaggagtcatccacttggtgggcagaggtggggtgggctgatggcagcctgtggaccaaaggccccacctctgcaaaaatggcaggtaagccttccttgagggctccaagagtggacagcatctgatggcttctctggaaggagctgcgcctctggatgagcctcctgtttcagg

SEQ ID NO: 108999 - DNA, 201 bp, Bos taurus
aactctggagacatgatcagtcaaccccagcagaaaaatgtgacggtagacagagtgctcctcaaagagaacgaatgtgtctgggactttcctggcagcctagtggttaagactcctagcttccagtacaggaggcacaggttggatctctggctggggagctaagaacccacatgccttgtggccaaaaaaacaaaacat

SEQ ID NO: 109000 - DNA, 201 bp, Bos taurus; identical to SEQ ID NO: 27992

SEQ ID NO: 109001 - DNA, 201 bp, Bos taurus; identical to SEQ ID NO: 27995

SEQ ID NO: 109002 - DNA, 201 bp, Bos taurus; identical to SEQ ID NO: 27997

SEQ ID NO: 109003 - DNA, 201 bp, Bos taurus; identical to SEQ ID NO: 28002

SEQ ID NO: 109004 - DNA, 201 bp, Bos taurus; identical to SEQ ID NO: 28004

SEQ ID NO: 109005 - DNA, 201 bp, Bos taurus; identical to SEQ ID NO: 28006

SEQ ID NO: 109006 - DNA, 201 bp, Bos taurus; identical to SEQ ID NO: 28007

SEQ ID NO: 109007 - DNA, 201 bp, Bos taurus; identical to SEQ ID NO: 28008

SEQ ID NO: 109008 - DNA, 201 bp, Bos taurus; identical to SEQ ID NO: 28009

SEQ ID NO: 109009 - DNA, 201 bp, Bos taurus; identical to SEQ ID NO: 28011

SEQ ID NO: 109010 - DNA, 201 bp, Bos taurus; identical to SEQ ID NO: 28012

SEQ ID NO: 109011 - DNA, 201 bp, Bos taurus; identical to SEQ ID NO: 28016

SEQ ID NO: 109012 - DNA, 201 bp, Bos taurus; identical to SEQ ID NO: 28018

SEQ ID NO: 109013 - DNA, 201 bp, Bos taurus; identical to SEQ ID NO: 28019

SEQ ID NO: 109014 - DNA, 201 bp, Bos taurus; identical to SEQ ID NO: 28022

SEQ ID NO: 109015 - DNA, 201 bp, Bos taurus; identical to SEQ ID NO: 28023

SEQ ID NO: 109016 - DNA, 201 bp, Bos taurus; identical to SEQ ID NO: 28028

SEQ ID NO: 109017 - DNA, 201 bp, Bos taurus; identical to SEQ ID NO: 28029

SEQ ID NO: 109018 - DNA, 201 bp, Bos taurus; identical to SEQ ID NO: 28030

SEQ ID NO: 109019 - DNA, 201 bp, Bos taurus; identical to SEQ ID NO: 28031

SEQ ID NO: 109020 - DNA, 201 bp, Bos taurus; identical to SEQ ID NO: 28032

SEQ ID NO: 109021 - DNA, 201 bp, Bos taurus; identical to SEQ ID NO: 28034

SEQ ID NO: 109022 - DNA, 201 bp, Bos taurus; identical to SEQ ID NO: 28035

SEQ ID NO: 109023 - DNA, 201 bp, Bos taurus; identical to SEQ ID NO: 28036

SEQ ID NO: 109024 - DNA, 201 bp, Bos taurus; identical to SEQ ID NO: 28037

SEQ ID NO: 109025 - DNA, 201 bp, Bos taurus; identical to SEQ ID NO: 28039

SEQ ID NO: 109026 - DNA, 201 bp, Bos taurus; identical to SEQ ID NO: 28042

SEQ ID NO: 109027 - DNA, 201 bp, Bos taurus; identical to SEQ ID NO: 28043

SEQ ID NO: 109028 - DNA, 201 bp, Bos taurus; identical to SEQ ID NO: 28044

SEQ ID NO: 109029 - DNA, 201 bp, Bos taurus; identical to SEQ ID NO: 28045

SEQ ID NO: 109030 - DNA, 201 bp, Bos taurus; identical to SEQ ID NO: 28047

SEQ ID NO: 109031 - DNA, 201 bp, Bos taurus; identical to SEQ ID NO: 28049

SEQ ID NO: 109032 - DNA, 201 bp, Bos taurus; identical to SEQ ID NO: 28055

SEQ ID NO: 109033 - DNA, 201 bp, Bos taurus; identical to SEQ ID NO: 28056

SEQ ID NO: 109034 - DNA, 201 bp, Bos taurus; identical to SEQ ID NO: 28057

SEQ ID NO: 109035 - DNA, 201 bp, Bos taurus; identical to SEQ ID NO: 28058

SEQ ID NO: 109036 - DNA, 201 bp, Bos taurus; identical to SEQ ID NO: 28059

SEQ ID NO: 109037 - DNA, 201 bp, Bos taurus; identical to SEQ ID NO: 28060

SEQ ID NO: 109038 - DNA, 201 bp, Bos taurus; identical to SEQ ID NO: 28061

SEQ ID NO: 109039 - DNA, 201 bp, Bos taurus; identical to SEQ ID NO: 28062

SEQ ID NO: 109040 - DNA, 201 bp, Bos taurus; identical to SEQ ID NO: 28063

SEQ ID NO: 109041 - DNA, 201 bp, Bos taurus; identical to SEQ ID NO: 28064

SEQ ID NO: 109042 - DNA, 201 bp, Bos taurus; identical to SEQ ID NO: 28065

SEQ ID NO: 109043 - DNA, 201 bp, Bos taurus; identical to SEQ ID NO: 28066

SEQ ID NO: 109044 - DNA, 201 bp, Bos taurus; identical to SEQ ID NO: 28071

SEQ ID NO: 109045 - DNA, 201 bp, Bos taurus; identical to SEQ ID NO: 28072

SEQ ID NO: 109046 - DNA, 201 bp, Bos taurus; identical to SEQ ID NO: 28074

SEQ ID NO: 109047 - DNA, 201 bp, Bos taurus; identical to SEQ ID NO: 28076

SEQ ID NO: 109048 - DNA, 201 bp, Bos taurus; identical to SEQ ID NO: 28081

SEQ ID NO: 109049 - DNA, 201 bp, Bos taurus; identical to SEQ ID NO: 28082

SEQ ID NO: 109050 - DNA, 201 bp, Bos taurus; identical to SEQ ID NO: 28083

SEQ ID NO: 109051 - DNA, 201 bp, Bos taurus; identical to SEQ ID NO: 28086

SEQ ID NO: 109052 - DNA, 201 bp, Bos taurus; identical to SEQ ID NO: 28089

SEQ ID NO: 109053 - DNA, 201 bp, Bos taurus; identical to SEQ ID NO: 28090

SEQ ID NO: 109054 - DNA, 201 bp, Bos taurus; identical to SEQ ID NO: 28093

SEQ ID NO: 109055 - DNA, 201 bp, Bos taurus; identical to SEQ ID NO: 28094

SEQ ID NO: 109056 - DNA, 201 bp, Bos taurus
aacagtatatcctcactggaaaaaaaaccagcaacccacgagtgaataagcgtgtccgcagcctggtggaagagtgactgatgctgtaactgaactcatcttcaagcacagctccgaatgcctgttaggctggaaaactgttgtgctgcgtggtaactggacataaaccaaggcggtcacatggctgattcacctgggctg

SEQ ID NO: 109057 - DNA, 201 bp, Bos taurus
atctgacattcgtcattttcttagcttgtgttctaagtgttatttattacaagtctgggtactgcattttcaaaataaaaaaattttaaaacataaatttgcacctaccaggacggctcagattaaacactaatgacattgctggcagagggcgagtgtaaattggaacaagcactgcagaacactaactctgttttctaa

SEQ ID NO: 109058 - DNA, 201 bp, Bos taurus; identical to SEQ ID NO: 28098

SEQ ID NO: 109059 - DNA, 201 bp, Bos taurus
tcgcttgtgttcttgaactggaaccgtaagaagagaactaatcgtcaatgccgctatgcagatgggggtccaccagtgtgacggcccaccacacactgcatgcaagcgccccaaggcaggtggaaaactctcatcttccaggcaggcaggatgccttcctacgtccatctgctctcagaaccttccagtgggccctggttt

SEQ ID NO: 109060 - DNA, 201 bp, Bos taurus; identical to SEQ ID NO: 28099

SEQ ID NO: 109061 - DNA, 201 bp, Bos taurus
gtaaaaacacgagcgaaaacaaggaccctgcctgctctgcttagggcgaaagacaatggcttggtgacggagatggccaaaaactgtccaggacaaagaacaggaaggcaataataatttaagaaaaaaggaggatgaaagttatgttaatacacatggccttaagatacaaaaaacacaaaaccttttttaaggtctcat

SEQ ID NO: 109062 - DNA, 201 bp, Bos taurus
gtgaggctaccatcagccttctgacggcacgtcaggaggagggccatctgcctcagtcatctgagaccctgaacagtgacgatgtccacgaccggatgtccggagcagacgatgcgggtgctggggcctcaccgtggtgggacagagcagcatggtgagagactgcatcaagcaactctcaacagcgctcgatgtaaaact

SEQ ID NO: 109063 - DNA, 201 bp, Bos taurus
gagggcgtctccgaccctctctgcatccccgccagccccctttccatcttcactcagtggggccagcgccctggtgatgagcctgtgtcctcagccttgcggtcgccttcactttgagggaaagtgagttgggggagggtggagggaatcctctccccacccccgaccctgctcgctaacccaggaagatgctgtgacttg

SEQ ID NO: 109064 - DNA, 201 bp, Bos taurus
aaaaagcacctccttccgcccctctggcaaggggccatgtgccctgccctcctcaccttaccccctggctccctagggtctggtgtccaggctgaggacccggcgacagggtctcctctgggcctctcaatgcccaaagaagctgacttagaactggcacagctttcaacgcctgtgggtttctccagattacaagaacca

SEQ ID NO: 109065 - DNA, 201 bp, Bos taurus; identical to SEQ ID NO: 28102

SEQ ID NO: 109066 - DNA, 201 bp, Bos taurus; identical to SEQ ID NO: 28103

SEQ ID NO: 109067 - DNA, 201 bp, Bos taurus; identical to SEQ ID NO: 28104

SEQ ID NO: 109068 - DNA, 201 bp, Bos taurus; identical to SEQ ID NO: 28105

SEQ ID NO: 109069 - DNA, 201 bp, Bos taurus
ctggctgtccggaagtggccgtggtcagggcggcgtggcccactggtggcttctcgcctcacgtctacgcggctgtggcgcggcccaccttcctggtagactcagcagcgcgtctccctccagtgaaattccacagaaacaggaggtgagtcagcacaacgagcaccgagctccggtgttgggcgtccaggctgaagtccg

SEQ ID NO: 109070 - DNA, 201 bp, Bos taurus; identical to SEQ ID NO: 28107

SEQ ID NO: 109071 - DNA, 201 bp, Bos taurus; identical to SEQ ID NO: 28108

SEQ ID NO: 109072 - DNA, 201 bp, Bos taurus; identical to SEQ ID NO: 28109

SEQ ID NO: 109073 - DNA, 201 bp, Bos taurus
ctggcgtgctgtgattcatagggtcgcaaagagtcgggcacaactgagcgactgaactgaactgaactgatgctgactaaatatactaccagttctttgattgtcattcttcactggccttgaatctgagggtataaggaggaggcttttgtttggttcatataatttaaatttggtatcttcaaagagaatttcttccta

SEQ ID NO: 109074 - DNA, 201 bp, Bos taurus
ccaaccatactgaatcatctgccccatgggtcaagtaactagttgtatgtatgtaaaactgcgtgtaaagaaaaacacattaaagtatttggccagttagtgtgaaagaatttttaaagaaatgaaatcctaaatgcatgatgaattgctatatattagacagcatgaatgaattggcccatgtgatgctttaatgtttat

SEQ ID NO: 109075 - DNA, 201 bp, Bos taurus; identical to SEQ ID NO: 28110

SEQ ID NO: 109076 - DNA, 201 bp, Bos taurus
cagaaaatcctagtatcctggttgctaactttaatttctttccacttggctacagggattaatccagtctcttttttcccttctacttgtccctgtcttgaatatcttaatttaaaatgacatcattaatattagtatttcttaagtattttatatattaaattgttcattaaagagattaggacacagtgatacaaaata

SEQ ID NO: 109077 - DNA, 201 bp, Bos taurus; identical to SEQ ID NO: 28111

SEQ ID NO: 109078 - DNA, 201 bp, Bos taurus; identical to SEQ ID NO: 28114

SEQ ID NO: 109079 - DNA, 201 bp, Bos taurus; identical to SEQ ID NO: 28117

SEQ ID NO: 109080 - DNA, 201 bp, Bos taurus
agatctctataagactggaactccatctttgagggtacagagagtccctaagaggagagaggtttgccaatatataattaaactccagggacttggagtgacatgtgaaaaatgttatgagatccagcagatagagcactgactggcaaaaagcctgaagaagcctcccagtggagagaaagaaacattcagcgtggacaa

SEQ ID NO: 109081 - DNA, 201 bp, Bos taurus; identical to SEQ ID NO: 28118

SEQ ID NO: 109082 - DNA, 201 bp, Bos taurus
gagtcagacacgacttaaacaacaacaacaaagggcatggatggcactttaattttcttaactgaagacaaataggtttttcagagaaaatagagcatgtagatctgctgctatttctgaaaatagagataggatgctattagggtgagggctacagggaaatgaggaagattagtcttctaaatggatcttaaattttgt

SEQ ID NO: 109083 - DNA, 201 bp, Bos taurus; identical to SEQ ID NO: 28121

SEQ ID NO: 109084 - DNA, 201 bp, Bos taurus; identical to SEQ ID NO: 28122

SEQ ID NO: 109085 - DNA, 201 bp, Bos taurus
agttgttgttgactcactgtctctcatgttcaatacccagtttatgaggaaataccattatatatagaacatacccacattggccctttgtgctttactacctttattgttatcaacttgttctcagttcagttcagttcagttgttcagtcgtgtctgactctttgtgaccccatgaatcgtagcacgccaggcctccct

SEQ ID NO: 109086 - DNA, 201 bp, Bos taurus
tggctggccttgactttggaccgaagattgggttggactcctgtcaattcgacatacctccctcttcagggatccatgactgagtatgtctgctcttcacgcagtgagggccaggaccacaagagagcttacccaagctcctggtcacacgtaaagcttcttgttacatgtcacagtagctcacagtcctccgaccaaagc

SEQ ID NO: 109087 - DNA, 201 bp, Bos taurus; identical to SEQ ID NO: 28123

SEQ ID NO: 109088 - DNA, 201 bp, Bos taurus
tcttcaaattatctggtaacatttgcttacctgtttcactcccttgcttaaaagctttcaatggtaactacagaaataataagcaacccttattgtgggattactatgaaccagattaaatgctttttatgtaataacttgcttattcctgcaacaattcactgagaattgcttttcctagttgcattgttttcagagaac

SEQ ID NO: 109089 - DNA, 201 bp, Bos taurus; identical to SEQ ID NO: 28128

SEQ ID NO: 109090 - DNA, 201 bp, Bos taurus; identical to SEQ ID NO: 28130

SEQ ID NO: 109091 - DNA, 201 bp, Bos taurus; identical to SEQ ID NO: 28131

SEQ ID NO: 109092 - DNA, 201 bp, Bos taurus; identical to SEQ ID NO: 28133

SEQ ID NO: 109093 - DNA, 201 bp, Bos taurus
ctattgggaattgctgcactgtttagactttcatcaacttgacatgaatgctatatctttagttataatgttggtaaagctgtcagacagagcagggccaggtacaaaaccttgttacttaaccctacaggacaactctccaacttcactgggttgacagtgattcaagaagaggccacacagtatggtaatatgtacttg

SEQ ID NO: 109094 - DNA, 201 bp, Bos taurus; identical to SEQ ID NO: 28136

SEQ ID NO: 109095 - DNA, 201 bp, Bos taurus; identical to SEQ ID NO: 28137

SEQ ID NO: 109096 - DNA, 201 bp, Bos taurus; identical to SEQ ID NO: 68059

SEQ ID NO: 109097 - DNA, 201 bp, Bos taurus; identical to SEQ ID NO: 28139

SEQ ID NO: 109098 - DNA, 201 bp, Bos taurus
aatgatctggaagcattcacagctgtacttggcactgctaattgggcattgggacagttttacagttaacctaggatatgagggtacaggcttggatataagatgcatatttctaagtcaagactaacagatagggtaactagtctcctggacactggaaatatatcagtggaagtttttattgtttggggactaacagag

SEQ ID NO: 109099 - DNA, 201 bp, Bos taurus
gttcttgaggccaactcataatttcttcgatctatgtctttaaaaacatatatctttgcagcaagaaaagactgtgtacactcacttgaatttgctttccattctgtaaaaggagagaatacgttctattgtttgttaaaatattttctttacaataatttcttgtattttaagggcaatttttaaagtttttgtttagga

SEQ ID NO: 109100 - DNA, 201 bp, Bos taurus; identical to SEQ ID NO: 28143

SEQ ID NO: 109101 - DNA, 201 bp, Bos taurus
attaggaatacaagatgggagttatgttattttataacttgcctttttttcacttgatgctgtaactcggacaacttcctggttcagagcatacagatgtaagtcttttctgatggcttcatttactatagaaatttttttttcaaataacctgcatatttccatttcctcctacatatttcagtttccagaattataata

SEQ ID NO: 109102 - DNA, 201 bp, Bos taurus; identical to SEQ ID NO: 28148

SEQ ID NO: 109103 - DNA, 201 bp, Bos taurus; identical to SEQ ID NO: 28150

SEQ ID NO: 109104 - DNA, 201 bp, Bos taurus; identical to SEQ ID NO: 28154

SEQ ID NO: 109105 - DNA, 201 bp, Bos taurus; identical to SEQ ID NO: 28155

SEQ ID NO: 109106 - DNA, 201 bp, Bos taurus; identical to SEQ ID NO: 28156

SEQ ID NO: 109107 - DNA, 201 bp, Bos taurus
agttagcagaagttttaagttgaaaaattttaatcaaaaaatagacatcagatatagcagctatccaaccctagtctcaagagagattttttaaaaagtaattttaaggggagccctcatgatagtgacttcatggtggtgatttaccataaacatccccaaagttgttcagtagtcaactttatcatccgtgaatatcta

SEQ ID NO: 109108 - DNA, 201 bp, Bos taurus; identical to SEQ ID NO: 28157

SEQ ID NO: 109109 - DNA, 201 bp, Bos taurus; identical to SEQ ID NO: 28159

SEQ ID NO: 109110 - DNA, 201 bp, Bos taurus
tggagattactaaaaaatatatattcttttaactatcatgtgatccagcaatcccacttctgagtatgtatctgaaggaattaaatcactgtgtggaagagataacctacacccccacattcactgcagcattcttcacaatagccaagatatggaagcagcctaaaagtccatcaacagatggtgaagaaaacgtgtgtg

SEQ ID NO: 109111 - DNA, 201 bp, Bos taurus
aagtatctttagtgcaaagacattaatttacacttctttgcattttctaatgcactttacatgtagaagacctttacaaaattacttgtcaacagagaaatagagaatctgagcgtatgtataataccgtactcagatttctataatcctttgtggtatgtgctacaaagcataactgtcacgtaacaattaagacagaaa

SEQ ID NO: 109112 - DNA, 201 bp, Bos taurus; identical to SEQ ID NO: 28161

SEQ ID NO: 109113 - DNA, 201 bp, Bos taurus; identical to SEQ ID NO: 28165

SEQ ID NO: 109114 - DNA, 201 bp, Bos taurus
aaggttaaccattggcatagtctaagtatattataaattattgttccatgatggcatgttaaaggtttaattacttttaaaatgtatgctaattttttctaaacaagacttaaagcagcagataagcacaaaggattttaactaaaatatacaaagttaaatatagttatttttataaaaatcaagtaatttcatttcatt

SEQ ID NO: 109115 - DNA, 201 bp, Bos taurus; identical to SEQ ID NO: 28167

SEQ ID NO: 109116 - DNA, 201 bp, Bos taurus; identical to SEQ ID NO: 28168

SEQ ID NO: 109117 - DNA, 201 bp, Bos taurus; identical to SEQ ID NO: 28169

SEQ ID NO: 109118 - DNA, 201 bp, Bos taurus
tggggctgcaggtatgttctttctctttaaattatcccttagggttctctcttccccagaggacctccagcttgggagctggatcttcccaatgtcaccacctttcctgagaccagaatggcaagctgcagaggggcaagagttaggttcaggaatacagagtcaaaaagctaccatcagcctacagtgctggaggccact

SEQ ID NO: 109119 - DNA, 201 bp, Bos taurus
gcaaccaacattacccatttcttctgtgctccaaagacacggcgtgcatgtacaagcaaataaacatgctctcctctttttgcacaaacggcagcacaccatatatgctgctccatacactgcctttttcacttaaacatattctaaggcttccctggtggcacagtggataagagtctgcctgccaatgcaggggacatg

SEQ ID NO: 109120 - DNA, 201 bp, Bos taurus
cccaacaagggcagaggcccagagagcagaagccacaaacccaaagcccagagcagatccatgaccagatcaaagccagaggtcctgcttctggcccagaggactttcactaaagctttttgagaccatccgtttcctttttcaaagagacagattaaaccccaaattaccagtgaggtctctgtacaacaaatctatttc

SEQ ID NO: 109121 - DNA, 201 bp, Bos taurus; identical to SEQ ID NO: 28172

SEQ ID NO: 109122 - DNA, 201 bp, Bos taurus; identical to SEQ ID NO: 28174

SEQ ID NO: 109123 - DNA, 201 bp, Bos taurus; identical to SEQ ID NO: 28176

SEQ ID NO: 109124 - DNA, 201 bp, Bos taurus
tcagaattaaggctaaatgcagtcttaagggtggggccctagtctgacaggactggtatcttcataagaagagacacagggatatccctgtgcacacacacaggaaaggccacttgaggacacagcaagaaggtggccaggagcagaggcctccccaaaccaaccccgatggcatcctggccttagacttctagcccccag

SEQ ID NO: 109125 - DNA, 201 bp, Bos taurus
actgccagcagtgctgtcattaatgggatagttggtgctccagccactgcaaggctgctgggcaaggcccagaaccagggccctggcctgacctcttcagagctcagatggcttcctggactctgggacttcccacttggatcagaacactgggggatgaccttcttctctccaatgggcacaccctgctctcttcaccct

SEQ ID NO: 109126 - DNA, 201 bp, Bos taurus
gtgtgatgtgattaaatttttctggttatataaataggcctgatggcagtggggaggaacccacagaggtgctgatggcagttgggaggaacttgcagaggtgctgaagtgctgggcccagtaaggaagcccacgctgtaaccaggtaaaaaatgagacgggtctgatttaaatctctggcggtgggtgtgaagaggaaac

SEQ ID NO: 109127 - DNA, 201 bp, Bos taurus
agcagagtatttttgaaagaaaaccctcagcaacactgaacaacctctctgtgccgctccatgtgaggacatggggctggaagaccccaggcatatcatgcagccactgactcattatcttcatctgcatctgccaggattccatcttaaaagatatttgcttgaccagcctgatttgcccttcacaaatgtaataaagaa

SEQ ID NO: 109128 - DNA, 201 bp, Bos taurus; identical to SEQ ID NO: 28177

SEQ ID NO: 109129 - DNA, 201 bp, Bos taurus
acaggccccactgagttcaacctttgagtcattccagcccaggcatcataaatgtgagtgaagaatccaggaccagtttcaaagacatgtaaactatacaatcacacaaggcccacactcagaagggcctatggttggtttaatctctattattaccaattacatctttgaacttgtgttttataagtgaagtccaaggga

SEQ ID NO: 109130 - DNA, 201 bp, Bos taurus
aggatctctgcctgcagggtattggtgttggcccactggcgagcagccagctcctagtgcagctggctgagggatccagggcatcccaaaacttgtatcagcctgctagtgagtggggccagatcccaagacagctggctgagggacctcaggtgtctcagagctggaggtgaccaactgatgggcatgctgggtcctata

SEQ ID NO: 109131 - DNA, 201 bp, Bos taurus
atgcttctcttgccccacatgtatctcccctactgcttgcctcccagtggctgttttctaacttaattcatacagagtcctttctgccacagatcactttatgtagcaatcataccatgactcatgtaaaagaagagagtaaacaccatttgttatttatctactatgtattgggcaggaaactgaccacatgggtcacaa

SEQ ID NO: 109132 - DNA, 201 bp, Bos taurus; identical to SEQ ID NO: 28178

SEQ ID NO: 109133 - DNA, 201 bp, Bos taurus; identical to SEQ ID NO: 28179

SEQ ID NO: 109134 - DNA, 201 bp, Bos taurus
gctgccactgtcatgaaagtgaagaggcctacatggcaaggaactgaggactgatggtctgagtgaacctgtgggaccagatccttgattgagccccagacgctggcggcccagataacagcttgactccaacctcatgagagacccagagccagaatcacctacctaagccactcccagattcctgaaccaaaggaaatg

SEQ ID NO: 109135 - DNA, 201 bp, Bos taurus; identical to SEQ ID NO: 28181

SEQ ID NO: 109136 - DNA, 201 bp, Bos taurus
aacatacacttctttatcgcacctgcatccctgctggtgggtagtgttccaaggaagcaatgccctctccacactcactgttttggggcaagtatgtgcacgggtgaataattacatagctgtttacttctatttttgtaaactagattcctcaataggtctctacagtttatatgtccgtagatatagtagattactttc

SEQ ID NO: 109137 - DNA, 201 bp, Bos taurus; identical to SEQ ID NO: 28183

SEQ ID NO: 109138 - DNA, 201 bp, Bos taurus; identical to SEQ ID NO: 28184

SEQ ID NO: 109139 - DNA, 201 bp, Bos taurus; identical to SEQ ID NO: 28185

SEQ ID NO: 109140 - DNA, 201 bp, Bos taurus; identical to SEQ ID NO: 28189

SEQ ID NO: 109141 - DNA, 201 bp, Bos taurus; identical to SEQ ID NO: 28193

SEQ ID NO: 109142 - DNA, 201 bp, Bos taurus; identical to SEQ ID NO: 28194

SEQ ID NO: 109143 - DNA, 201 bp, Bos taurus; identical to SEQ ID NO: 28195

SEQ ID NO: 109144 - DNA, 201 bp, Bos taurus; identical to SEQ ID NO: 28196

SEQ ID NO: 109145 - DNA, 201 bp, Bos taurus; identical to SEQ ID NO: 28197

SEQ ID NO: 109146 - DNA, 201 bp, Bos taurus; identical to SEQ ID NO: 28198

SEQ ID NO: 109147 - DNA, 201 bp, Bos taurus; identical to SEQ ID NO: 28199

SEQ ID NO: 109148 - DNA, 201 bp, Bos taurus; identical to SEQ ID NO: 28201

SEQ ID NO: 109149 - DNA, 201 bp, Bos taurus; identical to SEQ ID NO: 28202

SEQ ID NO: 109150 - DNA, 201 bp, Bos taurus; identical to SEQ ID NO: 28206

SEQ ID NO: 109151 - DNA, 201 bp, Bos taurus; identical to SEQ ID NO: 28208

SEQ ID NO: 109152 - DNA, 201 bp, Bos taurus; identical to SEQ ID NO: 28209

SEQ ID NO: 109153 - DNA, 201 bp, Bos taurus; identical to SEQ ID NO: 28211

SEQ ID NO: 109154 - DNA, 201 bp, Bos taurus; identical to SEQ ID NO: 28212

SEQ ID NO: 109155 - DNA, 201 bp, Bos taurus; identical to SEQ ID NO: 28213

SEQ ID NO: 109156 - DNA, 201 bp, Bos taurus; identical to SEQ ID NO: 28214

SEQ ID NO: 109157 - DNA, 201 bp, Bos taurus; identical to SEQ ID NO: 28215

SEQ ID NO: 109158 - DNA, 201 bp, Bos taurus; identical to SEQ ID NO: 28216

SEQ ID NO: 109159 - DNA, 201 bp, Bos taurus; identical to SEQ ID NO: 28219

SEQ ID NO: 109160 - DNA, 201 bp, Bos taurus; identical to SEQ ID NO: 28220

SEQ ID NO: 109161 - DNA, 201 bp, Bos taurus; identical to SEQ ID NO: 28221

SEQ ID NO: 109162 - DNA, 201 bp, Bos taurus; identical to SEQ ID NO: 28222

SEQ ID NO: 109163 - DNA, 201 bp, Bos taurus; identical to SEQ ID NO: 28223

SEQ ID NO: 109164 - DNA, 201 bp, Bos taurus; identical to SEQ ID NO: 28224

SEQ ID NO: 109165 - DNA, 201 bp, Bos taurus; identical to SEQ ID NO: 28225

SEQ ID NO: 109166 - DNA, 201 bp, Bos taurus; identical to SEQ ID NO: 28226

SEQ ID NO: 109167 - DNA, 201 bp, Bos taurus; identical to SEQ ID NO: 28227

SEQ ID NO: 109168 - DNA, 201 bp, Bos taurus; identical to SEQ ID NO: 28232

SEQ ID NO: 109169 - DNA, 201 bp, Bos taurus; identical to SEQ ID NO: 28235

SEQ ID NO: 109170 - DNA, 201 bp, Bos taurus; identical to SEQ ID NO: 28240

SEQ ID NO: 109171 - DNA, 201 bp, Bos taurus; identical to SEQ ID NO: 28243

SEQ ID NO: 109172 - DNA, 201 bp, Bos taurus; identical to SEQ ID NO: 28244

SEQ ID NO: 109173 - DNA, 201 bp, Bos taurus; identical to SEQ ID NO: 28245

SEQ ID NO: 109174 - DNA, 201 bp, Bos taurus; identical to SEQ ID NO: 28246

SEQ ID NO: 109175 - DNA, 201 bp, Bos taurus; identical to SEQ ID NO: 28247

SEQ ID NO: 109176 - DNA, 201 bp, Bos taurus; identical to SEQ ID NO: 28250

SEQ ID NO: 109177 - DNA, 201 bp, Bos taurus; identical to SEQ ID NO: 28251

SEQ ID NO: 109178 - DNA, 201 bp, Bos taurus; identical to SEQ ID NO: 28252

SEQ ID NO: 109179 - DNA, 201 bp, Bos taurus; identical to SEQ ID NO: 28254

SEQ ID NO: 109180 - DNA, 201 bp, Bos taurus; identical to SEQ ID NO: 28259

SEQ ID NO: 109181 - DNA, 201 bp, Bos taurus; identical to SEQ ID NO: 28260

SEQ ID NO: 109182 - DNA, 201 bp, Bos taurus; identical to SEQ ID NO: 28261

SEQ ID NO: 109183 - DNA, 201 bp, Bos taurus; identical to SEQ ID NO: 28264

SEQ ID NO: 109184 - DNA, 201 bp, Bos taurus; identical to SEQ ID NO: 28265

SEQ ID NO: 109185 - DNA, 201 bp, Bos taurus; identical to SEQ ID NO: 28271

SEQ ID NO: 109186 - DNA, 201 bp, Bos taurus; identical to SEQ ID NO: 28272

SEQ ID NO: 109187 - DNA, 201 bp, Bos taurus; identical to SEQ ID NO: 28273

SEQ ID NO: 109188 - DNA, 201 bp, Bos taurus; identical to SEQ ID NO: 28274

SEQ ID NO: 109189 - DNA, 201 bp, Bos taurus; identical to SEQ ID NO: 28275

SEQ ID NO: 109190 - DNA, 201 bp, Bos taurus; identical to SEQ ID NO: 28276

SEQ ID NO: 109191 - DNA, 201 bp, Bos taurus; identical to SEQ ID NO: 28277

SEQ ID NO: 109192 - DNA, 201 bp, Bos taurus; identical to SEQ ID NO: 28279

SEQ ID NO: 109193 - DNA, 201 bp, Bos taurus; identical to SEQ ID NO: 28280

SEQ ID NO: 109194 - DNA, 201 bp, Bos taurus; identical to SEQ ID NO: 28281

SEQ ID NO: 109195 - DNA, 201 bp, Bos taurus; identical to SEQ ID NO: 28282

SEQ ID NO: 109196 - DNA, 201 bp, Bos taurus
gggaaaaaagaaagcagtttccatgctttgctcctgtggtcatggggaattttgaacatgaacttgaggcattttcatgaaattcctgttttcatattttcagtttcacaagattttctcttctgactcctacttgacagaatcatctttgccctaaagtgctcttatttctggtctttgggataattaaggaacagccag

SEQ ID NO: 109197 - DNA, 201 bp, Bos taurus; identical to SEQ ID NO: 28283

SEQ ID NO: 109198 - DNA, 201 bp, Bos taurus
tatcatggccagtagctgtcactctgggtcactccacaaagggcgtggtctttcctcctcccacctcagccagttttgccaatctgactggccagcagctgggacagatctttctctgctgcatacagatgggcaccaacctgatcctgaaagctgggcatgggcacactgccaggccatcagcatcagctttctcaacag

SEQ ID NO: 109199 - DNA, 201 bp, Bos taurus
ctattaaaccctaaggccccgtttcccctcccctcagcccctggtaaccaccattctgctttctgccttgtgaacctgattaccctaggaacctcatatatgtgaaatcatagggcctcttttctttagtcagagtcttgtttcacttagtgtgttttattttctttaacaaatacttgcttgatactcatgtggtctgct

SEQ ID NO: 109200 - DNA, 201 bp, Bos taurus; identical to SEQ ID NO: 28286

SEQ ID NO: 109201 - DNA, 201 bp, Bos taurus
atcactccccactccttaagctcaggctgtgcttggtgacttcattccagagtggacagtatggaagaggggtgggagagaacctttacagtgaacaaatctgaaaagcactacctcacctgggtgatcgaggtcaacatcaacaatcaacatcatgttgagagtgtgtacttctgatatgatgtcatgacaactggcact

SEQ ID NO: 109202 - DNA, 201 bp, Bos taurus
gatttattttgtacattcttagcaagatgtgtcccatgctaatatcccctttgttttacaccatttcaatttaggaaaggtttcatagactgttctgctttagggtgtcctaggaaacctgtctggcctatttttgcatgtctctagatggtgactgcagccatgaaattaaaagacgcttactccttggaaggaaagtta

SEQ ID NO: 109203 - DNA, 201 bp, Bos taurus; identical to SEQ ID NO: 28287

SEQ ID NO: 109204 - DNA, 201 bp, Bos taurus
acagcctatctgtgtttaaatctcagccctgctactttctggttttgtaaatttaagcaagtttttttaatctcttgcttcagtgttcttagcttatccatttgtaagatttaaataaattaatatatagagagcactttgtacactaatccataggaagtacttaataaaagtactagcatcacgtgtaatcatttttat

SEQ ID NO: 109205 - DNA, 201 bp, Bos taurus; identical to SEQ ID NO: 28290

SEQ ID NO: 109206 - DNA, 201 bp, Bos taurus
cacctacactctgctcagcgctattctaaacactgggatgtagggatgaacaacacagcaaggccctggtacctgagtagtttatattccagctggagagacaggaaaaccataagcaaacaaaaaaacgaacaaatgatttcagacagtattgggtgctatgttagtttcttaggactgttacaacaaatgaccacaaac

SEQ ID NO: 109207 - DNA, 201 bp, Bos taurus
gccctggccatgaacccacactctggacggggcagcaaattcagtcaacaggatacagactctgcagacactcctaatgccagctctgtgccaggcactggactgaggggaagcggcctaccgtgaggcagtgctcttggcatgccagcatgtaaacaaacacagccctgctgccctctgcctgccaaaagcaaggtgcat

SEQ ID NO: 109208 - DNA, 201 bp, Bos taurus; identical to SEQ ID NO: 28292

SEQ ID NO: 109209 - DNA, 201 bp, Bos taurus; identical to SEQ ID NO: 28293

SEQ ID NO: 109210 - DNA, 201 bp, Bos taurus
ctggaggactttctctggccactaaagtgcaggcatgtgcagggcaggttagaagtgccaaggggttaacactcccgggtacatccctgaactgatgacctgtgggagtgggtggacatatggccccagcttcttgcccctctcatgggataactttggaccacattcaacactgtctccccgagctccccagggcagtca

SEQ ID NO: 109211 - DNA, 201 bp, Bos taurus
gctggaggggaaatccagtctccttcaccttgtgtttccctcttgagtcagtcgcaatttcccatttggtgctccttttcattgccaccgtggccatcattgtgggattgtatgtgccacgtggctttctcttctcttccacctctggtcatggacttcccaatagacagccaaagtggtttccttcagggttggcttggt

SEQ ID NO: 109212 - DNA, 201 bp, Bos taurus; identical to SEQ ID NO: 28294

SEQ ID NO: 109213 - DNA, 201 bp, Bos taurus; identical to SEQ ID NO: 28295

SEQ ID NO: 109214 - DNA, 201 bp, Bos taurus; identical to SEQ ID NO: 28296

SEQ ID NO: 109215 - DNA, 201 bp, Bos taurus; identical to SEQ ID NO: 28297

SEQ ID NO: 109216 - DNA, 201 bp, Bos taurus; identical to SEQ ID NO: 68201

SEQ ID NO: 109217 - DNA, 201 bp, Bos taurus; identical to SEQ ID NO: 28298

SEQ ID NO: 109218 - DNA, 201 bp, Bos taurus; identical to SEQ ID NO: 28299

SEQ ID NO: 109219 - DNA, 201 bp, Bos taurus; identical to SEQ ID NO: 28300

SEQ ID NO: 109220 - DNA, 201 bp, Bos taurus; identical to SEQ ID NO: 28301

SEQ ID NO: 109221 - DNA, 201 bp, Bos taurus; identical to SEQ ID NO: 28302

SEQ ID NO: 109222 - DNA, 201 bp, Bos taurus; identical to SEQ ID NO: 28304

SEQ ID NO: 109223 - DNA, 201 bp, Bos taurus; identical to SEQ ID NO: 28305

SEQ ID NO: 109224 - DNA, 201 bp, Bos taurus; identical to SEQ ID NO: 28306

SEQ ID NO: 109225 - DNA, 201 bp, Bos taurus; identical to SEQ ID NO: 28307

SEQ ID NO: 109226 - DNA, 201 bp, Bos taurus; identical to SEQ ID NO: 28308

SEQ ID NO: 109227 - DNA, 201 bp, Bos taurus; identical to SEQ ID NO: 28309

SEQ ID NO: 109228 - DNA, 201 bp, Bos taurus; identical to SEQ ID NO: 28310

SEQ ID NO: 109229 - DNA, 201 bp, Bos taurus; identical to SEQ ID NO: 28311

SEQ ID NO: 109230 - DNA, 201 bp, Bos taurus; identical to SEQ ID NO: 28312

SEQ ID NO: 109231 - DNA, 201 bp, Bos taurus; identical to SEQ ID NO: 28313

SEQ ID NO: 109232 - DNA, 201 bp, Bos taurus; identical to SEQ ID NO: 28314

SEQ ID NO: 109233 - DNA, 201 bp, Bos taurus; identical to SEQ ID NO: 28315

SEQ ID NO: 109234 - DNA, 201 bp, Bos taurus; identical to SEQ ID NO: 28316

SEQ ID NO: 109235 - DNA, 201 bp, Bos taurus; identical to SEQ ID NO: 28317

SEQ ID NO: 109236 - DNA, 201 bp, Bos taurus; identical to SEQ ID NO: 28318

SEQ ID NO: 109237 - DNA, 201 bp, Bos taurus; identical to SEQ ID NO: 28319

SEQ ID NO: 109238 - DNA, 201 bp, Bos taurus; identical to SEQ ID NO: 28320

SEQ ID NO: 109239 - DNA, 201 bp, Bos taurus; identical to SEQ ID NO: 28321

SEQ ID NO: 109240 - DNA, 201 bp, Bos taurus; identical to SEQ ID NO: 28322

SEQ ID NO: 109241 - DNA, 201 bp, Bos taurus; identical to SEQ ID NO: 28323

SEQ ID NO: 109242 - DNA, 201 bp, Bos taurus
atggcctttcctgtaactgtaaagctcacttgaaagttaaaaaaattcccataaagattaaaaaaaaagaaagactccatgcacacagcagtcagcttgcggaggccgagacatttgtttcgtaactagaccaaacttgaaagctctcaatttcgcctctaacaagatgtattccatcagagctttctacataaatcacag

SEQ ID NO: 109243 - DNA, 201 bp, Bos taurus; identical to SEQ ID NO: 28324

SEQ ID NO: 109244 - DNA, 201 bp, Bos taurus; identical to SEQ ID NO: 28326

SEQ ID NO: 109245 - DNA, 201 bp, Bos taurus; identical to SEQ ID NO: 28327

SEQ ID NO: 109246 - DNA, 201 bp, Bos taurus
cctaaggagaaggattaaattagatttcagtttaattaagaagagacattaagtgctaagaaggaggatggggcctgtgtggagggccaagggccagtgtcatgtctaaaatgttctacatccaccccgagaacccattttcacgcccaaagggagacagtgccccgtggagaatgcacggcctggttggtaatgagatgt

SEQ ID NO: 109247 - DNA, 201 bp, Bos taurus; identical to SEQ ID NO: 28331

SEQ ID NO: 109248 - DNA, 201 bp, Bos taurus; identical to SEQ ID NO: 28332

SEQ ID NO: 109249 - DNA, 201 bp, Bos taurus; identical to SEQ ID NO: 28333

SEQ ID NO: 109250 - DNA, 201 bp, Bos taurus
ttatgtccaccacctggtccatcagttctgtcttgggtcagttgcttccttgggctggttgtactcatttgaggggccaacactcacctggctgccactcttccaggtcagccgtctatgattctacaagatacctatgattcaacacatgggagcagttggcagtcatccttctgtgggtgccctgccccggcctctctg

SEQ ID NO: 109251 - DNA, 201 bp, Bos taurus; identical to SEQ ID NO: 28335

SEQ ID NO: 109252 - DNA, 201 bp, Bos taurus; identical to SEQ ID NO: 28336

SEQ ID NO: 109253 - DNA, 201 bp, Bos taurus; identical to SEQ ID NO: 28338

SEQ ID NO: 109254 - DNA, 201 bp, Bos taurus; identical to SEQ ID NO: 28339

SEQ ID NO: 109255 - DNA, 201 bp, Bos taurus; identical to SEQ ID NO: 28340

SEQ ID NO: 109256 - DNA, 201 bp, Bos taurus; identical to SEQ ID NO: 28342

SEQ ID NO: 109257 - DNA, 201 bp, Bos taurus; identical to SEQ ID NO: 28343

SEQ ID NO: 109258 - DNA, 201 bp, Bos taurus; identical to SEQ ID NO: 28345

SEQ ID NO: 109259 - DNA, 201 bp, Bos taurus; identical to SEQ ID NO: 28350

SEQ ID NO: 109260 - DNA, 201 bp, Bos taurus; identical to SEQ ID NO: 28351

SEQ ID NO: 109261 - DNA, 201 bp, Bos taurus; identical to SEQ ID NO: 28352

SEQ ID NO: 109262 - DNA, 201 bp, Bos taurus; identical to SEQ ID NO: 28355

SEQ ID NO: 109263 - DNA, 201 bp, Bos taurus; identical to SEQ ID NO: 28356

SEQ ID NO: 109264 - DNA, 201 bp, Bos taurus
atcactagtgatgatcccagggtgggccagcctgctggttgggattgtagattgtagcctagagtcatgtgtctaccttccctagtctaaatccaccatgggtggttggaacagactggctggcccttatgtgtttccccagctgaggaagtttttaattcagatgagtgggtttccctctgcagacagcagtccagtgtg

SEQ ID NO: 109265 - DNA, 201 bp, Bos taurus; identical to SEQ ID NO: 28364

SEQ ID NO: 109266 - DNA, 201 bp, Bos taurus
tgtgataaatgcattggcatagggggttatttcagaaaagaacaagcagctctttttttttttcgcttaatattggttaagttctcttcctcatccaacacgtatgttttggtccttgtgtcttggttccatcctttgacttgttttctacatgaaagcaaaatggatacaggcatgccaggtctttatccacataataca

SEQ ID NO: 109267 - DNA, 201 bp, Bos taurus; identical to SEQ ID NO: 28365

SEQ ID NO: 109268 - DNA, 201 bp, Bos taurus; identical to SEQ ID NO: 28366

SEQ ID NO: 109269 - DNA, 201 bp, Bos taurus; identical to SEQ ID NO: 28367

SEQ ID NO: 109270 - DNA, 201 bp, Bos taurus; identical to SEQ ID NO: 28368

SEQ ID NO: 109271 - DNA, 201 bp, Bos taurus; identical to SEQ ID NO: 28369

SEQ ID NO: 109272 - DNA, 201 bp, Bos taurus; identical to SEQ ID NO: 28370

SEQ ID NO: 109273 - DNA, 201 bp, Bos taurus
ctaaccacagactcatggggagatggtccctgtggcattggggggttcgccaaaatgtggatgcagggctcctggaattcacggatgatccagggaaaggaagctggtgggtcacagtcaaggggcccagcgggttaggaagtgggtgccatggaggcaagtgaccagaaagcgactcaagcacaggagagtgaggcgtgg

SEQ ID NO: 109274 - DNA, 201 bp, Bos taurus
tagcattttcagtgagaagggcagcgtttcaaaagcactctgggaagctgagtaaggatcttgcttctacagtgggtttaatttcaaggtaatcatggtgatatctcaggccctgagttcacaaaaatctgcaagccgagctatattactgacatcaggacgtagcaggccatcctctgtgataagaagcgctgtatcacg

SEQ ID NO: 109275 - DNA, 201 bp, Bos taurus; identical to SEQ ID NO: 28371

SEQ ID NO: 109276 - DNA, 201 bp, Bos taurus; identical to SEQ ID NO: 28372

SEQ ID NO: 109277 - DNA, 201 bp, Bos taurus; identical to SEQ ID NO: 28374

SEQ ID NO: 109278 - DNA, 201 bp, Bos taurus; identical to SEQ ID NO: 28375

SEQ ID NO: 109279 - DNA, 201 bp, Bos taurus
ctgagttaagcattgacccctctgggatgctgtgagattatgttacgagtgtctgttctctcactttttttgcccctaaaacatggtcaggcctggcaccgggtcacttgatctcccagactgatgaaggagagagcaggtgagaaggagaccgttgaggggggcgcagtcaaagtgaggctggagttctcagagtctgca

SEQ ID NO: 109280 - DNA, 201 bp, Bos taurus; identical to SEQ ID NO: 28377

SEQ ID NO: 109281 - DNA, 201 bp, Bos taurus; identical to SEQ ID NO: 28378

SEQ ID NO: 109282 - DNA, 201 bp, Bos taurus; identical to SEQ ID NO: 28379

SEQ ID NO: 109283 - DNA, 201 bp, Bos taurus; identical to SEQ ID NO: 28381

SEQ ID NO: 109284 - DNA, 201 bp, Bos taurus; identical to SEQ ID NO: 28384

SEQ ID NO: 109285 - DNA, 201 bp, Bos taurus
aaaaacaaaaaacctctctgcaaacttaaatgagcaaatgacctaaaggaaatttaccgccatggggagtcattaaatttgaaggcctccctgggggccttggagaagccatcactccatgactccagcccatggaatcatttgagaatgcccttcccgggactggataaaatgatgcaggctgattttccatctgcaggg

SEQ ID NO: 109286 - DNA, 201 bp, Bos taurus
aacatttgcatgtttaatgtcacgtgagccttcgtgcattcctctctccctggacactcagggcatccctccacattcctgaacctgggctggccgagaccgctttgccgggcaaaattcagccaaagtcgtgctgatccaggtctgggctagatttaagaggactggccactcccactcccttgctcttggaattctcag

SEQ ID NO: 109287 - DNA, 201 bp, Bos taurus
tgcatgcgtgtgtgaaatctccaggggacagagatgtgggacttggaatggcaggactcttggcagagtatctgtcggcctgccctgaagcatggagagcgtcatgtttcacttgggagcaagacctaagcctgagtgagatccctccccaagaagacagtccttgcctatctggaactggccctcagtcctttgagggga

SEQ ID NO: 109288 - DNA, 201 bp, Bos taurus
ctaggatggcccatatcctggcatctctgggtgctacagggaagatttctcaaacagcagtctttgtcactcattccacatttatttattatcttttgaacattaggaattatcacattgaaaacattatgcagtatgtgtcttaatagaacataccctaacctggctgcatggttataacaaaaaataaagagcccagag

SEQ ID NO: 109289 - DNA, 201 bp, Bos taurus
gtcttttggagaaactaaaatggtgtacccactggaacccagtagattttcaagacagatcacgtggactgggaatgaggcatttgtggagtcccaggcccctgtggaccagtgtgctgtgtatattcatccagtcctaacctagacaccttcgcttgactgcagataacactgacaccctagacatcagaaaattaaagg

SEQ ID NO: 109290 - DNA, 201 bp, Bos taurus; identical to SEQ ID NO: 28386

SEQ ID NO: 109291 - DNA, 201 bp, Bos taurus; identical to SEQ ID NO: 28387

SEQ ID NO: 109292 - DNA, 201 bp, Bos taurus; identical to SEQ ID NO: 28388

SEQ ID NO: 109293 - DNA, 201 bp, Bos taurus; identical to SEQ ID NO: 28389

SEQ ID NO: 109294 - DNA, 201 bp, Bos taurus
tacaaattaaatagtctccttaacatgaacactgagagcaactttgtagggagggctgccttgctgaagtccaccagaggcctcttcacgggcagggagacgcctgtggctgcacttccttcacattctttcgtgctgtccatctaccctaccctttccctccaaagtcttccttaggcccctcatcagcagctaacatcg

SEQ ID NO: 109295 - DNA, 201 bp, Bos taurus
acctttgtataatgatcctgtcaagaataatatctattcttgtgagttgtctatgtattgggcttggcaactcaagttcagtgtaacaaactgaaataattgttctatgtatgtgagaggcttttagaaatgagatgattctgggttatgatctcaagatgtatgtttgactgtccctgcagccatggtctctctatcaca

SEQ ID NO: 109296 - DNA, 201 bp, Bos taurus
gtttcctcgttaataaaaagatagaggctggtttggggtgcttagacatcaaagacactggtcttgagtcagatccaggttttatcatgtttagtttcgtccacagaaatcaaacaattttgaatcaacactcaaaaatcatgagataccaggtcaaaattgcaaatcccaggttcatttggaaaactggaagagctccaa

SEQ ID NO: 109297 - DNA, 201 bp, Bos taurus; identical to SEQ ID NO: 28393

SEQ ID NO: 109298 - DNA, 201 bp, Bos taurus
tatttatgcatttcctccttcatggacttgtaaataggagattacattttgtagtttagctattaataatatatattactaagttatacagttttgtttcgaattctggctccaccacttactatgtgcctatcactagctagattgatccaattatgtgaaagtttttagtataactggtattaattttcttttttttta

SEQ ID NO: 109299 - DNA, 201 bp, Bos taurus; identical to SEQ ID NO: 28394

SEQ ID NO: 109300 - DNA, 201 bp, Bos taurus; identical to SEQ ID NO: 28395

SEQ ID NO: 109301 - DNA, 201 bp, Bos taurus; identical to SEQ ID NO: 28396

SEQ ID NO: 109302 - DNA, 201 bp, Bos taurus; identical to SEQ ID NO: 28397

SEQ ID NO: 109303 - DNA, 201 bp, Bos taurus; identical to SEQ ID NO: 28398

SEQ ID NO: 109304 - DNA, 201 bp, Bos taurus; identical to SEQ ID NO: 28399

SEQ ID NO: 109305 - DNA, 201 bp, Bos taurus; identical to SEQ ID NO: 28402

SEQ ID NO: 109306 - DNA, 201 bp, Bos taurus; identical to SEQ ID NO: 28403

SEQ ID NO: 109307 - DNA, 201 bp, Bos taurus; identical to SEQ ID NO: 28404

SEQ ID NO: 109308 - DNA, 201 bp, Bos taurus; identical to SEQ ID NO: 28405

SEQ ID NO: 109309 - DNA, 201 bp, Bos taurus; identical to SEQ ID NO: 28406

SEQ ID NO: 109310 - DNA, 201 bp, Bos taurus; identical to SEQ ID NO: 28407

SEQ ID NO: 109311 - DNA, 201 bp, Bos taurus; identical to SEQ ID NO: 28408

SEQ ID NO: 109312 - DNA, 201 bp, Bos taurus; identical to SEQ ID NO: 28409

SEQ ID NO: 109313 - DNA, 201 bp, Bos taurus; identical to SEQ ID NO: 28410

SEQ ID NO: 109314 - DNA, 201 bp, Bos taurus
ttatatttgcatctccattatttagcacaatggttggccatatagaagataatcagtatcaaccgaaaaacagggctcccatgttgcaccaccaccatccagcattgttctgtgagttacctcttctttctcatatattgtccacgtgtccactgatgtttatggtgttggctctgtccccttggcttaaaaattggatag

SEQ ID NO: 109315 - DNA, 201 bp, Bos taurus
tgaactagtttggtgaaactattttgctgcagatttagtgatggaaaaacacatttgcctttaagtagaacaaagagaacactattgaaataaaatttcacgtgtccatttatggtcattttagggactgagtttctgtgtccacctcagtttccatcaagattcaggccttgaggcaatagtgtaagaaaatagcacatc

SEQ ID NO: 109316 - DNA, 201 bp, Bos taurus
acaactagtgctgggacacctgaaggtaatcgtgtgcacccggccctctgcaaactctaggttgggggtgcttcacacagggctcctttgaaagtgaggaatgattggaatcctgtataagaggccactgtcaaagcaaaaaagagaataatatctcccccatgaaagtgagagcagaggcaacctctgccactgactcct

SEQ ID NO: 109317 - DNA, 201 bp, Bos taurus
ggcaattcaaggtttttcagaacaactcttcataggctgtgattcttatccctacccccaatctcaagtacatcacacagggattcacagaagaaactcaatcaccagtttgcaaaagaattggggttggcaaattgttctaaagttaatacctaaacaaacagtaacctgtaagtccttgtataattggttactctggta

SEQ ID NO: 109318 - DNA, 201 bp, Bos taurus
aaatactagtgagtatccattaacctctagaaattgcatattattcaactgtaagagtcaaagatgagttttctgtccatcaggctgaactttgaagttccacagaagtccatagggcatgctttgagctgtagggacccagcacagctcactgataatgagctgatagggtctgaggctgttcccagatagaaattacat

SEQ ID NO: 109319 - DNA, 201 bp, Bos taurus; identical to SEQ ID NO: 28411

SEQ ID NO: 109320 - DNA, 201 bp, Bos taurus; identical to SEQ ID NO: 28412

SEQ ID NO: 109321 - DNA, 201 bp, Bos taurus
catcagtttcatgccaaatgatcttcagtttagtaccgtgatgaagccaaggtagtgactgttctccccgttttaacagataaagaaatgaagtcattcacacaaatgagaagtatctttgatcttggacaagtaagaaaaatgggagacaagcatgtaatgagcatcttcagcatgtaaggcatatgctggagaggaaac

SEQ ID NO: 109322 - DNA, 201 bp, Bos taurus; identical to SEQ ID NO: 28413

SEQ ID NO: 109323 - DNA, 201 bp, Bos taurus
gtttgccaaataaggtcccactctgaagccctggtggaatgacttcgggggcaccctttgcgccaggggagaatccactctgctttcagccacacccaccatgctgaaactctgaaaactctgatcccaaccatgcgggacactgaccggaaacgtccatgctcactgagcccacaacaggggctgcctcgggccagagct

SEQ ID NO: 109324 - DNA, 201 bp, Bos taurus
gaaaaatggcctaaaaatatcagatctttattgacacagaataggaaaattgactaaagttcctttatgtccaggactttctcctgttaatcaatagcctggggatgatcaaattaaggccccacttccctagagggacagtccctgctgtgacaaatctgaccttgttatcagagccaatttgagcactatctggtctaa

SEQ ID NO: 109325 - DNA, 201 bp, Bos taurus
tatgaatccacccctcctccaagtctccacaggactcagaggacccaggacagcctgaaaatcccaggtggatgagtgagcctccagaagacctgaagctgctattcagaaaggccaaaaatcttcttaaaccctaagctaagtacccatagcaactatcttctttatgcttcccagcaatcaatccactcagagtaatat

SEQ ID NO: 109326 - DNA, 201 bp, Bos taurus
gcagaggtgacggcagcggctccgcgtccgggtcaagcggccaaagtgacgaacgtggacgccaggggcacacgtggacgggtccgcgccccggcccgtcgctggtcctgcccagaaggggctggggagagggggcgctatttcaacctgcctgatgctcttgaactcagattttcccccttactctccaacttcaggcct

SEQ ID NO: 109327 - DNA, 201 bp, Bos taurus; identical to SEQ ID NO: 28414

SEQ ID NO: 109328 - DNA, 201 bp, Bos taurus
atttttcctacactattaaccccaatgtcagtaaagaaatcacagttctgagaagatagcagtgagtagcactggaatcaaggcccactgggaagtggaccgggagtagggtaacagagctgagttctgagagctgttcttccattccagtaacttgggagtaatgactgtggtcccagtggagaatctgagcagagatgt

SEQ ID NO: 109329 - DNA, 201 bp, Bos taurus; identical to SEQ ID NO: 28415

SEQ ID NO: 109330 - DNA, 201 bp, Bos taurus
tccctttcactttttgcacgtcttctccgtcaccgtccacactgaggccaccaccccgtgctgttggttctacctctgaagcgtctcctgtagcacgcccacccaccttgcagataggacggccctttgggccactgtagtcaccgcagtggccttctgcagccatgaagccgctcctgctctacaatcctgccttgattc

SEQ ID NO: 109331 - DNA, 201 bp, Bos taurus; identical to SEQ ID NO: 28416

SEQ ID NO: 109332 - DNA, 201 bp, Bos taurus
ttggctgggtgccctcgtgtaaccgtacggaacttcacggaatgcgggtcacggcttcattttcctttccgtctgaagaggcgagggcctgtgctagcaggtggggtgcttttctatgaagcgcagtgaaagcaagacgccagtgtggttcatgccagggccccgcagacggctcgcccgttcagaagacggcagttctct

SEQ ID NO: 109333 - DNA, 201 bp, Bos taurus; identical to SEQ ID NO: 28417

SEQ ID NO: 109334 - DNA, 201 bp, Bos taurus
tctccctttctcaaaaaccttcagcacagaaagaaagtgtgtatgagttttctcaaaagacaagaaagagaatgaatgtaaaataatccaagtcatgcatatttcaaaacaggaaaactgctgcagaacccacatgtggctttatataaaaggtatgttagcggaggacttaggagggaggtttgttctatatacctcaga

SEQ ID NO: 109335 - DNA, 201 bp, Bos taurus
taggtccgtgcaagaccttcctggtaggctggccgcccttcgtccaccccctccggatgcctatgttccctgctccaaggccctgccagagttctcttattaaattcacatactatactgtcccctccttccttaagaccttccagtgacttctagtttctctcaggataagaatacatttttcagttggcccatgcaagg

SEQ ID NO: 109336 - DNA, 201 bp, Bos taurus; identical to SEQ ID NO: 28418

SEQ ID NO: 109337 - DNA, 201 bp, Bos taurus
aaaacaagacttaataaagatcatttctgaaggggatcccagagctcctgccagcgtctttctggctccagggttttccctcaaactggccctctgaatacgtttgccaagtgtggggtatactgtatgcgttcaggaacccctaaatgctgctacattccatcagtgatcaaggccttaaggtctttagcaaatacttct

SEQ ID NO: 109338 - DNA, 201 bp, Bos taurus; identical to SEQ ID NO: 28419

SEQ ID NO: 109339 - DNA, 201 bp, Bos taurus; identical to SEQ ID NO: 28420

SEQ ID NO: 109340 - DNA, 201 bp, Bos taurus; identical to SEQ ID NO: 28421

SEQ ID NO: 109341 - DNA, 201 bp, Bos taurus
gcttgagtctttctctataggctccgaactttttaaaatgctctgccttcttcacttcattttctcaggcacctgatcttaactttctaaggtaaagactgcttagcagattaacttatctaactaaggtagctctcccaaatcatgttatgtgaaaaactagcctctaagatgctccatgaaagaaagtcaagtttgttt

SEQ ID NO: 109342 - DNA, 201 bp, Bos taurus; identical to SEQ ID NO: 28422

SEQ ID NO: 109343 - DNA, 201 bp, Bos taurus; identical to SEQ ID NO: 28423

SEQ ID NO: 109344 - DNA, 201 bp, Bos taurus; identical to SEQ ID NO: 28424

SEQ ID NO: 109345 - DNA, 201 bp, Bos taurus; identical to SEQ ID NO: 28425

SEQ ID NO: 109346 - DNA, 201 bp, Bos taurus; identical to SEQ ID NO: 28426

SEQ ID NO: 109347 - DNA, 201 bp, Bos taurus; identical to SEQ ID NO: 28427

SEQ ID NO: 109348 - DNA, 201 bp, Bos taurus; identical to SEQ ID NO: 28428

SEQ ID NO: 109349 - DNA, 201 bp, Bos taurus
tgggccccagtggtctaggccagtggttctccaagtgtggttcttaaatcagcaacatcagaatcaactgggggctggcttgttagaaatgtgcattctcggggccccaaccagatttgctcaatcagaaatcttggagttaaggcctaatgattaagcttttcacaagccctacagtgatctgatttctagtctgaaaat

SEQ ID NO: 109350 - DNA, 201 bp, Bos taurus
actttatgggaattttagtcaccatatttcatatgaagctcctaactacagcaaggaaaactacaattaccagaagttacgttttaagtggtaaataccacgtgtagatataccatcttcaggaatgaaaacgcttggcacccagggtcatttctacgcttttaagtttcctttgctagacttctggttagtcaattactt

SEQ ID NO: 109351 - DNA, 201 bp, Bos taurus
agagtccttcccaaacttaaaggacagtacagcagagaagattccagggctctgcttggtcacagaggtccagggtccactgcctaagcactattttaatcgcagattctaattcaaaccactattctgaaagcacggcgtaggtgggaatagaccatactttggcagagaaatttttgcagagggtttgtaagagtccag

SEQ ID NO: 109352 - DNA, 201 bp, Bos taurus; identical to SEQ ID NO: 28429

SEQ ID NO: 109353 - DNA, 201 bp, Bos taurus; identical to SEQ ID NO: 28430

SEQ ID NO: 109354 - DNA, 201 bp, Bos taurus
ttggaaaaaaggaaagctcggtgtgtgtgtgtgagtgtgtgtgtacacatgtagtttatcagaaaggaaaagccttcttccttgatcagaccgagttcactgcacagccctgacagtggcttaatttacatctgtttcatagaagagaaaaggtgagcagggttgtccaggtgccttccagcacattctctctgctctgca

SEQ ID NO: 109355 - DNA, 201 bp, Bos taurus; identical to SEQ ID NO: 28431

SEQ ID NO: 109356 - DNA, 201 bp, Bos taurus; identical to SEQ ID NO: 28432

SEQ ID NO: 109357 - DNA, 201 bp, Bos taurus; identical to SEQ ID NO: 28433

SEQ ID NO: 109358 - DNA, 201 bp, Bos taurus; identical to SEQ ID NO: 28434

SEQ ID NO: 109359 - DNA, 201 bp, Bos taurus
tggcccatgtgggtttaaaaaagaagggctttttcctgccctctccccacataaagcacacactaacacacaagcgcacacgcacaggcaggcacacaacacagcagtggcgacagtccgcacagggacagattccagtagctcttgctctgctcctcaagaaggattttctggagtatttttgaaggatcttccagagct

SEQ ID NO: 109360 - DNA, 201 bp, Bos taurus
cccaggggactcattccaggcagacacactgtattgatcctgtttatgacatattctagttgctattggcaaaatacctttcttctgggagtaaaatgacgtgtttacaagcaaaattggaggcataaaagattttcagtaaactccttagggctcattagaattggggtctattttatgcactctggtttgggtagatcc

SEQ ID NO: 109361 - DNA, 201 bp, Bos taurus
tgaatgagtttcttgaactcatttagtgccttgtctataacagtcccattaccaagccaccatgtaacttggcaactgttcatcaggggtggcctccggactgaataagcaagaaggaaatccagccacttgcctcagcacttcatgttatacctgatgctcttggcaggctgtgattgaaagcaggtccttgccgcatgg

SEQ ID NO: 109362 - DNA, 201 bp, Bos taurus
gtgcttgtggttgaaatgcagtcatacaggaaacaagaatgacattgagcagtggatcagagatggtattaaggttttgataattactgaaaattataatccttgcccaatctgaaatgctcacatatataagtaaaaagactgctattgagatgacctattagttattttaaaagagaaacatacttggtaacatactgt

SEQ ID NO: 109363 - DNA, 201 bp, Bos taurus; identical to SEQ ID NO: 28435

SEQ ID NO: 109364 - DNA, 201 bp, Bos taurus; identical to SEQ ID NO: 28436

SEQ ID NO: 109365 - DNA, 201 bp, Bos taurus
ttccactgtttccccatcttatttcccatgaagtgatcggaccagatgccatgatcttagtttttctactcagagcaacttttagagctgataattattagtatctttcagagcctgtttttaagagtagataacacactgtatgttttttataataaaggaatcacatggtccaatgccatcctgagaaatttttttttt

SEQ ID NO: 109366 - DNA, 201 bp, Bos taurus; identical to SEQ ID NO: 28437

SEQ ID NO: 109367 - DNA, 201 bp, Bos taurus
gttatttcctactaaatacatacagttcaacacaataaccctcacattctgccctgagtcactcatatacttaaaggcaagtcttaattttaggtaacatccctcagactggttagtcatgcctaaggggttcttctttggactgagcagagtgagatgaccatggttggcatttccatattttctaattaaaatttaaaa

SEQ ID NO: 109368 - DNA, 201 bp, Bos taurus; identical to SEQ ID NO: 28438

SEQ ID NO: 109369 - DNA, 201 bp, Bos taurus
aaataacactggttctttcttaatacttttctctctcaaaccttcactgacttgtagaaggcttacctgtgcaaggtgagcccaggatgtagctgacttcggtatggagcattaactttgatgactcccagtttcatttccatgaaagttactgtagattttccaaacaaaggcattttcaataagggtgaatattagaga

SEQ ID NO: 109370 - DNA, 201 bp, Bos taurus
aagtgacagaatagttcatttcagatacaagggtctttggttcaagtgccaaaatggaaggatttgtcataaaaccgcaaaaagaagtttgattaaagaacctttaatgaagatctgacatttaatctggtcttttattggataagatctttaaatattctctccttatgaattcgtttcatattcactggaatggtactt

SEQ ID NO: 109371 - DNA, 201 bp, Bos taurus; identical to SEQ ID NO: 28439

SEQ ID NO: 109372 - DNA, 201 bp, Bos taurus; identical to SEQ ID NO: 28440

SEQ ID NO: 109373 - DNA, 201 bp, Bos taurus
tgctctgtttgaaaccaagtacaccttttaaactgtctggaagtttgatctattacagatctgagcagattaaactcttttggcccacagtttaaaaaaaaattttaaaaactctccaggactggaatctaaatgtaggaaaagtaaggacactgcataaactgtatggaaagattgaggcctctgggtatgaagtctcca

SEQ ID NO: 109374 - DNA, 201 bp, Bos taurus
actttcctatgcacgtgaatcactgaggactttggtgaagtgtggattctgctccattaggtctagggtgggacctgagtcctaacaagcttccaggatgcccaggcctctgatcgtggacaccacttagtgtagccaggccaccagagaatccagccaaagggagagtgggtgtaccacagcccaggcagcctggaccag

SEQ ID NO: 109375 - DNA, 201 bp, Bos taurus
gaagttggagccaaaagtttacaaggtggagggtgggccttgtaggcagaaggcagagcgggtgcttgcacaggcatgaacagtgagagagcacagcatgttgttgcatgtggctgtacacggaggctggggtgatgaagggccagagtatgaaggggcctggccttgtgccctgaaagtctggtttaggatgcagatttc

SEQ ID NO: 109376 - DNA, 201 bp, Bos taurus; identical to SEQ ID NO: 28442

SEQ ID NO: 109377 - DNA, 201 bp, Bos taurus; identical to SEQ ID NO: 28443

SEQ ID NO: 109378 - DNA, 201 bp, Bos taurus
gatctgggtcaaagattatctatgtttttaacttaactttgctttataaactttgatttttgtaaagtattaatatcctcccaatactgcattgtggcccaaaaactgatacttttctggtggcaagttctctgcctgggctttagccctcctgccgtttgtgggcagagggagagaacggtcagcgaatatagatgtcta

SEQ ID NO: 109379 - DNA, 201 bp, Bos taurus
catcctcctccctccaccttttcgtagctagaaagtgtccaactggcaatgttcaaatcgtaaaggcagcaaaaacggccctgcgtgctgtcacaaatgtctaaaaagtggattagggatcaccagggagggacagctcggacacccgaggcccccgtcctccgcgcggggctggcgcagctcggctccctgcccagcccg

SEQ ID NO: 109380 - DNA, 201 bp, Bos taurus
aagaaaataattagcttcatatacaccaagaacattaaaactagtatgaatacattttctgataccagtttttttcctaagaaaaagttttaggtccagcgtatagttttactttatgatagtatctcctacagtttaactttattgctaatacacaaagacatggagcctgtggcatatacataaaaaaagatgaagcct

SEQ ID NO: 109381 - DNA, 201 bp, Bos taurus
gcatctccctcaaagaagttttgcatttttttctgccggctttatcagtttgtttttttttttcacccagggtaatagaagtgctaactctaaacccataggaggcagtgttgttgtttatttgctaagtcatgtccaactcttttttttttttttttaattaatttttttttttttttttaattttattttacatgtcca

SEQ ID NO: 109382 - DNA, 201 bp, Bos taurus
taccatttctgtcctttattgtgcctgtctttgcatgaaatgttctagggataatctaaatcagatctgtccctcatcacaaaaagatctcaccagcagattcatctatgccaataacttaagacagctttttatttcaagataggagatttacttcccaaatgcactgaaaacctaactgatccctggcttgagtgggca

SEQ ID NO: 109383 - DNA, 201 bp, Bos taurus; identical to SEQ ID NO: 28444

SEQ ID NO: 109384 - DNA, 201 bp, Bos taurus; identical to SEQ ID NO: 28445

SEQ ID NO: 109385 - DNA, 201 bp, Bos taurus; identical to SEQ ID NO: 28446

SEQ ID NO: 109386 - DNA, 201 bp, Bos taurus
ttattctgattaaccaatctccaggaatgctacaaaacctaagtattaaatctgttccctccagcttcagtttattgttaccctgtccctggttctgcagcttttcatgtggcactagtggtaaagaacccacctgccaatgtaagagacaaaggagacacgggttccatccctgggtttggaagatcccctggaggagaa

SEQ ID NO: 109387 - DNA, 201 bp, Bos taurus; identical to SEQ ID NO: 28447

SEQ ID NO: 109388 - DNA, 201 bp, Bos taurus; identical to SEQ ID NO: 28448

SEQ ID NO: 109389 - DNA, 201 bp, Bos taurus; identical to SEQ ID NO: 28449

SEQ ID NO: 109390 - DNA, 201 bp, Bos taurus
ttattttagctaaaggattctgttttgtctttccagattttctgtcagatattgatgataaaactagcctccagccagttatttgattcacatctgtcatctgtcaggaacacaactttctctgactagctgttccttttcttcttttaaggttccttttactttatagaatcaatcaaatattgctggaactcagtggga

SEQ ID NO: 109391 - DNA, 201 bp, Bos taurus; identical to SEQ ID NO: 28450

SEQ ID NO: 109392 - DNA, 201 bp, Bos taurus; identical to SEQ ID NO: 28451

SEQ ID NO: 109393 - DNA, 201 bp, Bos taurus; identical to SEQ ID NO: 28452

SEQ ID NO: 109394 - DNA, 201 bp, Bos taurus; identical to SEQ ID NO: 28453

SEQ ID NO: 109395 - DNA, 201 bp, Bos taurus; identical to SEQ ID NO: 28454

SEQ ID NO: 109396 - DNA, 201 bp, Bos taurus; identical to SEQ ID NO: 28455

SEQ ID NO: 109397 - DNA, 201 bp, Bos taurus; identical to SEQ ID NO: 28456

SEQ ID NO: 109398 - DNA, 201 bp, Bos taurus
atattataagaatttacatagaaattgtaattatttcattatgtataagtaaaataaaccagaattagaaggagcattttcttcattgcctcatttcagcatactgtctcatttcatttattgattcttttctaatccttacatgaaatttcagtatgtttttaatttgagggtgttagtcttgccttactcttcctcaaa

SEQ ID NO: 109399 - DNA, 201 bp, Bos taurus; identical to SEQ ID NO: 28458

SEQ ID NO: 109400 - DNA, 201 bp, Bos taurus; identical to SEQ ID NO: 28459

SEQ ID NO: 109401 - DNA, 201 bp, Bos taurus
attccttgactcatggccgccacctctgtttttaaactggcagcacagcttcttcaaatctccgactctgagtgtcctcttgcctcctttatctgttaaacgtccctgttaccacaggggcccacctaaccagttcagtgtaattgctctatctcaagatccttaatttagtcatacctcagaattccttatgccatgcca

SEQ ID NO: 109402 - DNA, 201 bp, Bos taurus; identical to SEQ ID NO: 28464

SEQ ID NO: 109403 - DNA, 201 bp, Bos taurus; identical to SEQ ID NO: 28466

SEQ ID NO: 109404 - DNA, 201 bp, Bos taurus
agtctatcagtaatactttgccatggtgattttatattcttttataacaatcacaataggtttcttagaaagaagaataaattctgaagagagactaagtgtatgaaaagtggaaaataactcttagtcaaaagtgtgaaagaaatcacacaaataaaggcattccgtttcaaaacccaggtgggaagattaaaatcgaaa

SEQ ID NO: 109405 - DNA, 201 bp, Bos taurus; identical to SEQ ID NO: 28469

SEQ ID NO: 109406 - DNA, 201 bp, Bos taurus
acttcacataaatggacttctatcacacattctttctttaatggagtccttctggttttggctcccacgcagtcccattttctaaacagtctcatggccctttggagggtgggtctgtgtgcccacaagagaccccgtggtctccccaggctcactcttgaagcagggtcctccgattcaggggtgccctctggcaggcct

SEQ ID NO: 109407 - DNA, 201 bp, Bos taurus; identical to SEQ ID NO: 28474

SEQ ID NO: 109408 - DNA, 201 bp, Bos taurus
actgggaaaaaccttttatggcttttctggttggcctcctcacagcaaggcgcccatgggtaacaacggaaatgctgtgataatatcctgccagttctgacgaggcctgatctcatctgttctttgaagtccttcatggagaagctgatgggtgcagagtagctgttacatgtttcctggtaccagtccttcagagaacta

SEQ ID NO: 109409 - DNA, 201 bp, Bos taurus
ttttaattaaaataatgttatttctgattttttttaaaggtaagaagtttgattatttttcattttcatattatatgtgagcagagaaccttttgataacaggtcaaattaaaatgtgacaaatttgttgaagagaaactttattttcctcttgtatttatactgcatataaattaaataccgtcttggcatatttcattg

SEQ ID NO: 109410 - DNA, 201 bp, Bos taurus
tgagcttaatctactgtaccagaggtaaacttctaacttctttttaaacaattacattttcagtcattaactctacttccgaagtaactcagtggcaccagtatctgagctttttggaggtcctttgtccaagtgacagtaccgttgctactatattcaccctgaaaagctcttttagcgagcatgaaatgacacatgaat

SEQ ID NO: 109411 - DNA, 201 bp, Bos taurus; identical to SEQ ID NO: 28475

SEQ ID NO: 109412 - DNA, 201 bp, Bos taurus
catgattgagaaacgtaagcctcattccagtaagtccctctttgtaggtttgttcacagtattataaaccacttgtccgtgtttagagcgtctcttcttgctgtttgtctgtcttggttactgtctgtctcagttatgagtactaagtcttttccccaaatgacttgaagtgatttttaaatccatttattttttttttcc

SEQ ID NO: 109413 - DNA, 201 bp, Bos taurus; identical to SEQ ID NO: 28477

SEQ ID NO: 109414 - DNA, 201 bp, Bos taurus
ttaaagataataggtaaatgaaatgaacatccaataaaaaccagtttgtgtatttaaacagaactaaaaggctaaacttagaatgtaagagagaataggagtaaagctgttcatgaaagcagtcaattcagttgatattttgtcattttcctgactttctctaacttaaaggaaaaaaaaaatgtatcatacccccacatc

SEQ ID NO: 109415 - DNA, 201 bp, Bos taurus; identical to SEQ ID NO: 28481

SEQ ID NO: 109416 - DNA, 201 bp, Bos taurus
gcttctgctctgtcttcattcctctcttttcattaattcatttattcctgttagaatgacctaggctcatttttcttctcatgatgtccaagattttttttaaatttatttaattggaggctaattactttgcaataaacctgtatgcgagatagcaaaaaagacacagatgtatagaacaagatttttatttattgaaat

SEQ ID NO: 109417 - DNA, 201 bp, Bos taurus; identical to SEQ ID NO: 28483

SEQ ID NO: 109418 - DNA, 201 bp, Bos taurus; identical to SEQ ID NO: 28484

SEQ ID NO: 109419 - DNA, 201 bp, Bos taurus; identical to SEQ ID NO: 28485

SEQ ID NO: 109420 - DNA, 201 bp, Bos taurus; identical to SEQ ID NO: 28486

SEQ ID NO: 109421 - DNA, 201 bp, Bos taurus; identical to SEQ ID NO: 28487

SEQ ID NO: 109422 - DNA, 201 bp, Bos taurus
ggtataaatggtaagacaaaatggccagagagaaatcaggagccgggggacaaggacgcagacacagatgcggtgacctctgatcatccaaagttgtttactgaacacatttttgtgctaaggccgcctgctgttcccactctgcatgcagccttcactcctaattaaagccagtgggctaggatggaaaaaaacaatttc

SEQ ID NO: 109423 - DNA, 201 bp, Bos taurus; identical to SEQ ID NO: 28489

SEQ ID NO: 109424 - DNA, 201 bp, Bos taurus
ggtccatgccaaatggatttggataggaccaaatgtcaaagactttggtgtagaccaaatgtcttatggatgttttggacaggaccagatgtctacaaaatcttgcacattgctccaattcagacaatggctgtgtaatggccatgacacaggagccatgagaatgggtggcattgcccctgcaaagtgagctgagtgaga

SEQ ID NO: 109425 - DNA, 201 bp, Bos taurus; identical to SEQ ID NO: 28490

SEQ ID NO: 109426 - DNA, 201 bp, Bos taurus; identical to SEQ ID NO: 28491

SEQ ID NO: 109427 - DNA, 201 bp, Bos taurus; identical to SEQ ID NO: 28492

SEQ ID NO: 109428 - DNA, 201 bp, Bos taurus; identical to SEQ ID NO: 28494

SEQ ID NO: 109429 - DNA, 201 bp, Bos taurus; identical to SEQ ID NO: 28495

SEQ ID NO: 109430 - DNA, 201 bp, Bos taurus
aggtaggaacttgctatgaattttctagaacatgacagagtccggtagggctggagtagagtgcacagaggttacttggggaatctaaggtgggaaattacctaggggccagaccaagaaggactttcttagccatggtaaggatgtgcagttttgttcttagtggtgttcaaagctgtagaacgatttggacccagaaaa

SEQ ID NO: 109431 - DNA, 201 bp, Bos taurus
atgtcctcacgaggtgggcctaagacagtgacaccaaactccatgtcttggaacccaccctccatctgaacccaaagattaaaaaggcagtaagcttcatatttaggccagagatgcaaaagttcctccccctcaatccctaatactgagtttggcaaggggtatttttttttccaaaaagttaaatgagaaactatatca

SEQ ID NO: 109432 - DNA, 201 bp, Bos taurus; identical to SEQ ID NO: 28496

SEQ ID NO: 109433 - DNA, 201 bp, Bos taurus; identical to SEQ ID NO: 28498

SEQ ID NO: 109434 - DNA, 201 bp, Bos taurus; identical to SEQ ID NO: 28501

SEQ ID NO: 109435 - DNA, 201 bp, Bos taurus; identical to SEQ ID NO: 28502

SEQ ID NO: 109436 - DNA, 201 bp, Bos taurus
tacacacagagggaagaagcttttgaaggtgtatctttgccgtcatcgctctgtcttgtaacaagccctgcagtccttgccagtaggtgggcttcctctgtgtggtacctgcttcggcttagcaacatcctcatctcttacaaggatgctgttgaaaatggctgaacctgaggagacacctggtggagacaggaagcattc

SEQ ID NO: 109437 - DNA, 201 bp, Bos taurus; identical to SEQ ID NO: 28503

SEQ ID NO: 109438 - DNA, 201 bp, Bos taurus; identical to SEQ ID NO: 28504

SEQ ID NO: 109439 - DNA, 201 bp, Bos taurus
ggacctactctaactaggccagtgattctggtagctgccagaagacaaggtgaatggcttctgcagaccgtggacctggccccaaggctggccagagcatctgcctttggattcacaaaaatctaccccacaaacagaatcccatgagggcatgctatcttctgtttcaatgtccacgttataatccatattactatttta

SEQ ID NO: 109440 - DNA, 201 bp, Bos taurus; identical to SEQ ID NO: 28505

SEQ ID NO: 109441 - DNA, 201 bp, Bos taurus
cacgaggcctcagagctgtacgtgacttggggtgtcacatggtccagctgtctgctgcccacgcatcacctcccgtccccagctgtttctccccagcccttggccttgttcaggagtttcagaccatgttctgagctgtcctcggagtctactgaggcacattagctcctaccgtggggctgtgaggagactgaacgggaa

SEQ ID NO: 109442 - DNA, 201 bp, Bos taurus
agagtcagacatgacttagcgcctgaacaacaacgagctaaagggaagagtgatagaaagggctagagagcagggcctgtgagcagatgtcagactccagggttatttcatccagagtggaaaagtctagaaggaagaggatgagagggcctgggttgatttaacaacgcgctttaagcccacgagaggctcttactctca

SEQ ID NO: 109443 - DNA, 201 bp, Bos taurus; identical to SEQ ID NO: 28507

SEQ ID NO: 109444 - DNA, 201 bp, Bos taurus; identical to SEQ ID NO: 28508

SEQ ID NO: 109445 - DNA, 201 bp, Bos taurus; identical to SEQ ID NO: 28509

SEQ ID NO: 109446 - DNA, 201 bp, Bos taurus; identical to SEQ ID NO: 28512

SEQ ID NO: 109447 - DNA, 201 bp, Bos taurus
gtgaaccagaaaaaaatggaaaatatgaacagaataatgacaagtactgaaattgaaactgtgattaaaacttccaaacaaaaggccagggacggaaaacgtagcaggtgaattatttcaagcatttagagaagagttaacacctattcttcccaaatcattccaaaaaattgcagaagaaggaacactccaaagctcatt

SEQ ID NO: 109448 - DNA, 201 bp, Bos taurus
ttcgaagctggaccttcaagctgcaactgagaatgtgagtagtccaaccccttataggaagaaagtgagagctgggtgctttggcctgctccatctataatgcacctgggaataaccatgagatgtgctcatagacacatgaaaaatctgcttctttgtttaatgggagactcatggaggccaagtcccagtggctttctg

SEQ ID NO: 109449 - DNA, 201 bp, Bos taurus
agtgttcccctgttgaaaatgaatgattttatacaagaccaacacctgtaatcaaaatggatgaaggaaaaagagaaaagcactctttaagcaaggccctccactttatttctgagaagggtaaaacctgaaaattgtccaagttacaatagtgaccaaacacccccttttcctggccaatgagtaattcctgcttcttta

SEQ ID NO: 109450 - DNA, 201 bp, Bos taurus
tggtctatagtttctactgagacatctgcttatagcctggttggggtttcattgtaagttacttcatttttttctgcatttcagattatttatttttgacgatttcatacaatgagtcttacagaaggtctttttgcgttaatctgccctgttgtctgtactttctattgcattcttcatcttatttcttgaattcttcag

SEQ ID NO: 109451 - DNA, 201 bp, Bos taurus; identical to SEQ ID NO: 28517

SEQ ID NO: 109452 - DNA, 201 bp, Bos taurus; identical to SEQ ID NO: 28518

SEQ ID NO: 109453 - DNA, 201 bp, Bos taurus; identical to SEQ ID NO: 28519

SEQ ID NO: 109454 - DNA, 201 bp, Bos taurus; identical to SEQ ID NO: 28524

SEQ ID NO: 109455 - DNA, 201 bp, Bos taurus
aggcggggatttattcagaaagtaaatgaatggaggaaaatggaaatcagcttcctcattgtcagaaaagggagttacaaaatgtgaagggagaaaattggatgaattggaggtattgatgagaactcaagttggataataaaatgaatgtagatatggatatatatctatgtatacggtcagacacacacgtgtgtacat

SEQ ID NO: 109456 - DNA, 201 bp, Bos taurus; identical to SEQ ID NO: 28525

SEQ ID NO: 109457 - DNA, 201 bp, Bos taurus; identical to SEQ ID NO: 28526

SEQ ID NO: 109458 - DNA, 201 bp, Bos taurus
aagaggagctggccaccctcagctcctcccatttctctggccagggttgtctccagctcattcaatgagcactgaggccgtctttccccttctgctcagaatgctcactgttggctcctccctgtttagagagggctgcagcctgcctccctcctgttcggaggtcctgggcccggcgggtgggctcctctccagtcctca

SEQ ID NO: 109459 - DNA, 201 bp, Bos taurus; identical to SEQ ID NO: 28528

SEQ ID NO: 109460 - DNA, 201 bp, Bos taurus; identical to SEQ ID NO: 28529

SEQ ID NO: 109461 - DNA, 201 bp, Bos taurus; identical to SEQ ID NO: 28531

SEQ ID NO: 109462 - DNA, 201 bp, Bos taurus; identical to SEQ ID NO: 28537

SEQ ID NO: 109463 - DNA, 201 bp, Bos taurus; identical to SEQ ID NO: 28543

SEQ ID NO: 109464 - DNA, 201 bp, Bos taurus
tgtaggacaatggattttaaattttatttgcaaatttgtgtttgctttcatgaactagaatctcataaactcaactttatgaatgtgaaaggcctactccaattagcaaaaacacgtatactttaaagatttttaaatgaggacccaagtatatgtagtaactacaaccagaataacaatgagctgtcttttagaaggcca

SEQ ID NO: 109465 - DNA, 201 bp, Bos taurus
atttctcccagcaatctggattccagtttgtgactcattcagcttggctctcgcataaatgtactctgcatacaagttaaataagcagggccctcaaaacggtgtgtcccatcccaacccagggggagttgtgaggagttttatagtcaagggtagggttgctgatacggaatgggtgtgtgcagggccctcacgccttca

SEQ ID NO: 109466 - DNA, 201 bp, Bos taurus; identical to SEQ ID NO: 28544

SEQ ID NO: 109467 - DNA, 201 bp, Bos taurus; identical to SEQ ID NO: 28545

SEQ ID NO: 109468 - DNA, 201 bp, Bos taurus; identical to SEQ ID NO: 28546

SEQ ID NO: 109469 - DNA, 201 bp, Bos taurus; identical to SEQ ID NO: 28547

SEQ ID NO: 109470 - DNA, 201 bp, Bos taurus; identical to SEQ ID NO: 28548

SEQ ID NO: 109471 - DNA, 201 bp, Bos taurus; identical to SEQ ID NO: 28549

SEQ ID NO: 109472 - DNA, 201 bp, Bos taurus; identical to SEQ ID NO: 28550

SEQ ID NO: 109473 - DNA, 201 bp, Bos taurus; identical to SEQ ID NO: 28551

SEQ ID NO: 109474 - DNA, 201 bp, Bos taurus; identical to SEQ ID NO: 28552

SEQ ID NO: 109475 - DNA, 201 bp, Bos taurus; identical to SEQ ID NO: 28553

SEQ ID NO: 109476 - DNA, 201 bp, Bos taurus; identical to SEQ ID NO: 28554

SEQ ID NO: 109477 - DNA, 201 bp, Bos taurus; identical to SEQ ID NO: 28558

SEQ ID NO: 109478 - DNA, 201 bp, Bos taurus; identical to SEQ ID NO: 28561

SEQ ID NO: 109479 - DNA, 201 bp, Bos taurus; identical to SEQ ID NO: 68465

SEQ ID NO: 109480 - DNA, 201 bp, Bos taurus; identical to SEQ ID NO: 28562

SEQ ID NO: 109481 - DNA, 201 bp, Bos taurus; identical to SEQ ID NO: 28564

SEQ ID NO: 109482 - DNA, 201 bp, Bos taurus; identical to SEQ ID NO: 28565

SEQ ID NO: 109483 - DNA, 201 bp, Bos taurus; identical to SEQ ID NO: 28566

SEQ ID NO: 109484 - DNA, 201 bp, Bos taurus; identical to SEQ ID NO: 28567

SEQ ID NO: 109485 - DNA, 201 bp, Bos taurus
gaccaggtgtgtggggccatggatcacctgtactgcaccagctgtccacagagagggcagcctatggattaccttctgccctcaaatacgatgggcaggccggtgaagtcattcttcattccgcctgcagtctgcctaccctgaatatggatcctaacgatctttgtttgttgtttaggggacaaaaggcctggctgaggc

SEQ ID NO: 109486 - DNA, 201 bp, Bos taurus; identical to SEQ ID NO: 28569

SEQ ID NO: 109487 - DNA, 201 bp, Bos taurus; identical to SEQ ID NO: 28570

SEQ ID NO: 109488 - DNA, 201 bp, Bos taurus; identical to SEQ ID NO: 28571

SEQ ID NO: 109489 - DNA, 201 bp, Bos taurus; identical to SEQ ID NO: 28572

SEQ ID NO: 109490 - DNA, 201 bp, Bos taurus; identical to SEQ ID NO: 28575

SEQ ID NO: 109491 - DNA, 201 bp, Bos taurus; identical to SEQ ID NO: 28576

SEQ ID NO: 109492 - DNA, 201 bp, Bos taurus; identical to SEQ ID NO: 28577

SEQ ID NO: 109493 - DNA, 201 bp, Bos taurus; identical to SEQ ID NO: 28579

SEQ ID NO: 109494 - DNA, 201 bp, Bos taurus
ttgaccattagtggattataggcaggacatgtgatcaagtgctcatacctgggtctgttccctgggactcccaggggccctccagtgccttagccccacacccccatcttcgaggaggcaggcttcttactcagaccccaccagcagcaaagcaaaaccgtggccagaacccggggctctggctcgcaggccaggcctcat

SEQ ID NO: 109495 - DNA, 201 bp, Bos taurus; identical to SEQ ID NO: 28580

SEQ ID NO: 109496 - DNA, 201 bp, Bos taurus
acagaagaagttaaaaccgagggaaccactttggaagtgacaggtgcaagagattaaaaccctgttgttagtactgacagcataggaagaggcttatagatcttgagaaatataagctggaccaaggaactatccaaaaatgaactgaccccacactgcccacaacaacatcagagaaagtcctagatatatttttactat

SEQ ID NO: 109497 - DNA, 201 bp, Bos taurus
gtttgatccccttgtagtccaagggactctctagagtcttgtccaacaccacagtccaaaagcatccattctttagcagtcagtcttctttaagggccaaatttcacatccatacatagctactggaaacccatagatttgactagacagactttgtcagcaaagtaatgtctctgttttttaatatgctgtctatttagg

SEQ ID NO: 109498 - DNA, 201 bp, Bos taurus; identical to SEQ ID NO: 28589

SEQ ID NO: 109499 - DNA, 201 bp, Bos taurus
cagaatcaggcctgccgcttcagctggatgacttgttccccgaggtcacctcctacctcttgggtctgtttcactcacagcctcatcttgaagacccaaccaagttctggccccttctcccacaaagcattttctgttttcttccacatcttccaaattagatcaactttctcctctgaacctctgatcaactgttaccgc

SEQ ID NO: 109500 - DNA, 201 bp, Bos taurus
acatgactgagcagctaacactttcactctccccaggctttggggagcaaaggtgttccctggcaggtctcacacaggctgtttctggaaatctggccaagccagccctcagcccctggctgctgctcccctggacctgttgctcctccttggaattcacgctactggacagcttgtttttcatacacattttgctttatc

SEQ ID NO: 109501 - DNA, 201 bp, Bos taurus; identical to SEQ ID NO: 28590

SEQ ID NO: 109502 - DNA, 201 bp, Bos taurus; identical to SEQ ID NO: 28591

SEQ ID NO: 109503 - DNA, 201 bp, Bos taurus; identical to SEQ ID NO: 28594

SEQ ID NO: 109504 - DNA, 201 bp, Bos taurus; identical to SEQ ID NO: 28595

SEQ ID NO: 109505 - DNA, 201 bp, Bos taurus
gagaatcccagggacagagaagcctagtggcctgccgtctatggggtcatacagagttggacacgactgaagcgacttagcagcagcagcagcagcagcagcagctcctgcatggcaggccgataattatttacatattcttcagttcagtcactcagttgtgtccgattctttgtgaccccatggactgcagcacaccag

SEQ ID NO: 109506 - DNA, 201 bp, Bos taurus; identical to SEQ ID NO: 28596

SEQ ID NO: 109507 - DNA, 201 bp, Bos taurus; identical to SEQ ID NO: 28597

SEQ ID NO: 109508 - DNA, 201 bp, Bos taurus
agtccatccaggaggaaggactctcctctgagatcagtgggacagtgtctggagactcatatcctgagagagggactcgtgaaggcaaaccagccagcagtgtggcctcagactgtgcttccctgtccaggtctgacccttgataatggccccgatactttgggataggaggattatggaggtggatcaagaaagtaggta

SEQ ID NO: 109509 - DNA, 201 bp, Bos taurus
tggaaattcagagaatacagaatataaaagttgaaaaaagtctcagtaaatgggttgaatagccaagtggattcagttaaagaaccaattagtgagccagacaactattcaaatactctgaaggcctgaggagcagacagagagaaggaaaaaaaaacagaagctaagcaaggtacagaatagagttatttgatcagtgtt

SEQ ID NO: 109510 - DNA, 201 bp, Bos taurus; identical to SEQ ID NO: 28598

SEQ ID NO: 109511 - DNA, 201 bp, Bos taurus; identical to SEQ ID NO: 28599

SEQ ID NO: 109512 - DNA, 201 bp, Bos taurus
gaagagtcaatctcagtttaacttcctcatttgacagacgaggtggaaatgaagtggattccttagtcacgctgaacccagaaagcccttttatgaggagcggtgagggccgaagaagagatttcccttctgtactacttagaaaggaacttcttgggtgattcagtaccccacggagggaatcagggcccagatggcctt

SEQ ID NO: 109513 - DNA, 201 bp, Bos taurus
gccccagtgctctctaacaccagtgtccaggccacagcgatgtctaaatcacgaacacgatgtcagctcagtgttaaaacatatgctacaaactttgagcaaataactggccagtcagaggagtctgttttcactgtgaatcaggtcagtgcaatgagactctcaacccgagacatttcctcacccctcaagtcacactgt

SEQ ID NO: 109514 - DNA, 201 bp, Bos taurus; identical to SEQ ID NO: 28600

SEQ ID NO: 109515 - DNA, 201 bp, Bos taurus; identical to SEQ ID NO: 28601

SEQ ID NO: 109516 - DNA, 201 bp, Bos taurus
ggtgaaggacccagcccatttataaaggctgtggccttccccatgtgtcatagtgtgtgattttaattttgcaagaccctggccaggaaagaaagaataacgggtcaacatgacctcctatcttgtttaagtttgaaaaatctatttcaagaagctaagcacaaaatggccttcctcgaagagatttttctgcattagggt

SEQ ID NO: 109517 - DNA, 201 bp, Bos taurus
aatttgctagacaagccagcacaggagaaagctgagttctggggagaagcaggggttggggagaagagaccttatgtggcctaaggatgaacacgaggggaaaagtgcccagtggtttgggctggagatccagaatataaatgtgctggaaaggatgaagagggccagattcatggactgcagacccctgctttgtagaca

SEQ ID NO: 109518 - DNA, 201 bp, Bos taurus; identical to SEQ ID NO: 28603

SEQ ID NO: 109519 - DNA, 201 bp, Bos taurus; identical to SEQ ID NO: 28604

SEQ ID NO: 109520 - DNA, 201 bp, Bos taurus
acagagagagagcgagctgatgagcagggaggatgagctcaggggaaaatgtgttggttagtttccagtcagtgatgatatccacaagcagaaaggcccagtgagcatttggacagtcaaaggttctgaagtcatttcagcgaacaaaagcaatgaaatggatgaggcctgtgagggatcagtgcaaatagaaaaaactag

SEQ ID NO: 109521 - DNA, 201 bp, Bos taurus; identical to SEQ ID NO: 28606

SEQ ID NO: 109522 - DNA, 201 bp, Bos taurus
cccatgcaatggaaaatccatgtataacttcagactccccccacatttaaccactaatagttcgatgttaaccaaaagccttaccaataacatacaaagtcgataaacatattttgtatatgtattttacactgtattcttacaataaagtaagccagagaaaagaaaatattattaagatcataagaaaaaggacataca

SEQ ID NO: 109523 - DNA, 201 bp, Bos taurus
ggaaaaaagttgctctaaggcttcgcttaactctgggtttccctcttctctcagattttggccttataattcttcagtgcctttttagctctctggtggtttaaaagatatatatatatatatgtgtgtgtgtgtgtatgtattttaaattgtgttaagttttacataactgaacttaacattttagtcacctttaattgt

SEQ ID NO: 109524 - DNA, 201 bp, Bos taurus
acccctggtgcagtgtcatctgtcactctggagagctgtcctggcaggaaagtatcaaatgcctgcccctggaagcacatctccagggtgataatggcccacatcaagaccagagtctcttcgttatagtacctcgggtaagatgaattgctccacaggcttgtaccacagcttgttcacctgcacaccacagctcggagg

SEQ ID NO: 109525 - DNA, 201 bp, Bos taurus; identical to SEQ ID NO: 28607

SEQ ID NO: 109526 - DNA, 201 bp, Bos taurus
gttctggctctgccacaacctattatccaaaagatcacagaattatgctatcatcctcagtacaatgtatttttcaaacattcaccttcatgaaatatgggagggctactacacctgcccctacaccaagtcatgactacatattcttaacttttaggcatttttaaaatatattatcgattctatgctttaagcagtgct

SEQ ID NO: 109527 - DNA, 201 bp, Bos taurus
ccccccgtccggcccccagactcgctcctgcgcttgcgcacttgcccgcctcacgcgtcccgagccccgcccctcgccggtaaggcagcgccagcgtcgcggtcgtaacgcgtggaggccggagccaatgaggaagagaggaaggcaggccgagctctcggggtggggccggggccggggcccgggctttctcctcgcggc

SEQ ID NO: 109528 - DNA, 201 bp, Bos taurus; identical to SEQ ID NO: 28608

SEQ ID NO: 109529 - DNA, 201 bp, Bos taurus
ctgcctatattcttttgcgactatttttttaataggtaagaagtaaatttatcgagagagagagacacagagtgtgggccatctcgaaaagtgagagctttctatgactacattttttgcccaatagactgttgagatttattcattaactctacttcattcatttaattaattaattttgggggccacactgtatggctt

SEQ ID NO: 109530 - DNA, 201 bp, Bos taurus; identical to SEQ ID NO: 28609

SEQ ID NO: 109531 - DNA, 201 bp, Bos taurus
agttatcttctccttagttttacaagtcataaagatgggactctttattagtgagctaagcatagacacataaagatgggccaaactgggatttcccagacagtcaagtggtttagactccttgcttccagtgtagggggctcgggttgaatccttggcctgggaactaagattccacatgctgtgcagtgctgtggaagg

SEQ ID NO: 109532 - DNA, 201 bp, Bos taurus; identical to SEQ ID NO: 28610

SEQ ID NO: 109533 - DNA, 201 bp, Bos taurus
cttgcaaagggggcctcacccaggcctgggtgcatgagatgccccatattaccccccgcccctgaaaccaaagaccaagatgcctccaaaggaagagatattaaggccccactttcctttgtcatcaaataagtgccgtttcattttcatgctctttattttatgggaggagctaacatgaggttgaggccagggtagttc

SEQ ID NO: 109534 - DNA, 201 bp, Bos taurus
tggcctgagcatgcctgcacccttcaggacctgtggatagtaggacctttttgttttttcaaaagttccctgatagtaattgctgaggtgagtcttgcaactgtgataagaatcgctagggccagtcaggccgtggccttggctccgccctggctcagcactgggggtaaggccccaggtgaatgcctcatgcatttccta

SEQ ID NO: 109535 - DNA, 201 bp, Bos taurus
accattttccaaaggaattctttcagacctgtgaattaaagctgtacagtaaccgctaacattattaaacatttatagtgtggccagcactgcactaagcactttacatggattttttatttaattctcatgaagtagatgttttcattatccccattttagaagcgaggatacgggaacaaagaggttagtaactcttga

SEQ ID NO: 109536 - DNA, 201 bp, Bos taurus
atctttgtgcaactgttatgttgaaaggccagagctgactagagacctatggaaagcaactttattcttttttctcactctctttaaaactatttaaaggtttgctttgggcctgtttccatgaatgaaatcttgaccctgtaatttagaggactctcctgtccctttcagttgcaggagtgtgttggttcagtgctcaaa

SEQ ID NO: 109537 - DNA, 201 bp, Bos taurus; identical to SEQ ID NO: 28611

SEQ ID NO: 109538 - DNA, 201 bp, Bos taurus
caccagcaataagagagatactttctgcatgaatgtttttggaggcagaaagataagccaattaaacattttgttttctgatgcatatgtaacatttgtatacatggatgatctttttgaaatatgtgacttgctactgtttacagtgatatttagactgaaatctctcagggctggagcccagattttcaaattatttgg

SEQ ID NO: 109539 - DNA, 201 bp, Bos taurus; identical to SEQ ID NO: 28612

SEQ ID NO: 109540 - DNA, 201 bp, Bos taurus; identical to SEQ ID NO: 28613

SEQ ID NO: 109541 - DNA, 201 bp, Bos taurus; identical to SEQ ID NO: 28614

SEQ ID NO: 109542 - DNA, 201 bp, Bos taurus
aatactgtctaatagctgctaaatattaggcttcaagcttcctttattgtttcaaaggtgtatttttaccattggttcgtttgaattaggcctcatatgagggtcactgttgtctattcttcacagttggagccattcattgtcacagatcttgcactgttgggtcagttgtaaaaatggccatgtaaaggactataacaa

SEQ ID NO: 109543 - DNA, 201 bp, Bos taurus
gagcagacttaactgctttagttcagatgcagcattttaattattgctgtgatccttttgtggaaactaatcatatggccctatatatacccaagacaaacagaaaatacagttgtgtgctcagaaaggagaaatagtttggtgcttaattggccacattatggatgaagtattcttgtttctataaaatacatgcccctt

SEQ ID NO: 109544 - DNA, 201 bp, Bos taurus; identical to SEQ ID NO: 28615

SEQ ID NO: 109545 - DNA, 201 bp, Bos taurus; identical to SEQ ID NO: 28616

SEQ ID NO: 109546 - DNA, 201 bp, Bos taurus
gtaatacaggtttgcttaagacatttgggttgtctatacagtttttactgattcattctttttggtagttaccaaccttctgcaagtttccatatcaagcgtatagtgggagcaacatatgtgttctatataactacctcatgaccacacataggaacatacatgggaacgagactaacctgagacactcaagcttttccc

SEQ ID NO: 109547 - DNA, 201 bp, Bos taurus; identical to SEQ ID NO: 28617

SEQ ID NO: 109548 - DNA, 201 bp, Bos taurus; identical to SEQ ID NO: 28618

SEQ ID NO: 109549 - DNA, 201 bp, Bos taurus
ccatctgtgtccctgagagcatctcatttcctagggatgcctgctcccctgtatcagttatctccttgcccccctgccactcagcacacctgcccaaccagagctcggggccaagctgagtagcaacacccctgtgggagatctgccctccaaccagtattcaccttgaataaaagaggctgctaggcaggatcccacagt

SEQ ID NO: 109550 - DNA, 201 bp, Bos taurus; identical to SEQ ID NO: 28619

SEQ ID NO: 109551 - DNA, 201 bp, Bos taurus; identical to SEQ ID NO: 28620

SEQ ID NO: 109552 - DNA, 201 bp, Bos taurus
aaccatcccttgctgtctgccttgactgattctctgtccatgaccctgggacctcacaggacaggggccgtcattgtggcccaggggttcttctctcaggtatccctcctgccactcaggctgctgtttatgggtctatctcaccctctagaacagaagctccgggggcagggctgtgtctgtcctattggccactggcac

SEQ ID NO: 109553 - DNA, 201 bp, Bos taurus; identical to SEQ ID NO: 28621

SEQ ID NO: 109554 - DNA, 201 bp, Bos taurus
tactcagatcatgcaggttatcttcttgtgaatcattttggttagggatggttgtcaggaactcttcgagactcagggggataaatgagggttagatttaatttttttgtagcagatagcatgaaggccagaatgcggtagttgaagatgtattttcttaatgtaaaataaatattttatctgaagtattttatattcatt

SEQ ID NO: 109555 - DNA, 201 bp, Bos taurus; identical to SEQ ID NO: 28622

SEQ ID NO: 109556 - DNA, 201 bp, Bos taurus; identical to SEQ ID NO: 28623

SEQ ID NO: 109557 - DNA, 201 bp, Bos taurus
cgaaaaactcacacttacagtatgtatcttgattttgaagctcttgatcctttgaaagaaagcatgtaacaggttggatatatgttaaactgactagttagtgctctttggtttaagtgcatttggtatttgtggttttttttttcatttctttttataattaccttctgtttttacttggaaaatttttattaagaaata

SEQ ID NO: 109558 - DNA, 201 bp, Bos taurus
gaggtagcttcaaatataaacttggtcttccttgaggcatttttgtggggttctgattatgtccttagctaagtctctctggccaacaggaaatgagatatcacatttcttaagagataatcaggccttagcaataccaacacttgtaatgaaattgcaaggactcccaaccaaattaccaactctttcgtagggaaggac

SEQ ID NO: 109559 - DNA, 201 bp, Bos taurus
ctgtcagccttcccactgggctggtgtcagaaggggcccagtggaaaccaggactcttcatcatagccaagggatgataataaggtgctaacccctgcagtgccagtgaaggccacacaggaagcagtaataccgtctttctctttcagactttcttcacttagtatggcaatctctaggtccattgatgttgctgcaaat

SEQ ID NO: 109560 - DNA, 201 bp, Bos taurus; identical to SEQ ID NO: 28625

SEQ ID NO: 109561 - DNA, 201 bp, Bos taurus; identical to SEQ ID NO: 28626

SEQ ID NO: 109562 - DNA, 201 bp, Bos taurus; identical to SEQ ID NO: 28627

SEQ ID NO: 109563 - DNA, 201 bp, Bos taurus; identical to SEQ ID NO: 28628

SEQ ID NO: 109564 - DNA, 201 bp, Bos taurus; identical to SEQ ID NO: 28629

SEQ ID NO: 109565 - DNA, 201 bp, Bos taurus; identical to SEQ ID NO: 28631

SEQ ID NO: 109566 - DNA, 201 bp, Bos taurus; identical to SEQ ID NO: 28632

SEQ ID NO: 109567 - DNA, 201 bp, Bos taurus; identical to SEQ ID NO: 28633

SEQ ID NO: 109568 - DNA, 201 bp, Bos taurus; identical to SEQ ID NO: 28634

SEQ ID NO: 109569 - DNA, 201 bp, Bos taurus; identical to SEQ ID NO: 28635

SEQ ID NO: 109570 - DNA, 201 bp, Bos taurus; identical to SEQ ID NO: 28636

SEQ ID NO: 109571 - DNA, 201 bp, Bos taurus; identical to SEQ ID NO: 28637

SEQ ID NO: 109572 - DNA, 201 bp, Bos taurus; identical to SEQ ID NO: 28638

SEQ ID NO: 109573 - DNA, 201 bp, Bos taurus; identical to SEQ ID NO: 28639

SEQ ID NO: 109574 - DNA, 201 bp, Bos taurus
acgagctgatgagaaatgtgtagggttgtggaaagcaaatcagagaagctgagtgagtgaggagaaaataatggtccgtgtcagcaaagggatggcccagtgtgagagatgaaagcctggtgagattttaaactgcccacatgcccattcctgcaggtttccgtgaacaaatagggccacatgtggtcacaccaaaaatat

SEQ ID NO: 109575 - DNA, 201 bp, Bos taurus; identical to SEQ ID NO: 28641

SEQ ID NO: 109576 - DNA, 201 bp, Bos taurus; identical to SEQ ID NO: 28644

SEQ ID NO: 109577 - DNA, 201 bp, Bos taurus; identical to SEQ ID NO: 28646

SEQ ID NO: 109578 - DNA, 201 bp, Bos taurus; identical to SEQ ID NO: 28648

SEQ ID NO: 109579 - DNA, 201 bp, Bos taurus; identical to SEQ ID NO: 28649

SEQ ID NO: 109580 - DNA, 201 bp, Bos taurus
tccacaaaaggccatgcagcaacgaagacccagtacagccataaataaataagtagaattatatatatataaaatcctagcacatttttatagtaagaaatctaaaaaaaaataatgcgatactgaaaaaaagcacctgtaaatatgttgattaataaatatgagacatatggtaagccacagcttaacttaccctcctta

SEQ ID NO: 109581 - DNA, 201 bp, Bos taurus; identical to SEQ ID NO: 28651

SEQ ID NO: 109582 - DNA, 201 bp, Bos taurus; identical to SEQ ID NO: 28652

SEQ ID NO: 109583 - DNA, 201 bp, Bos taurus; identical to SEQ ID NO: 28653

SEQ ID NO: 109584 - DNA, 201 bp, Bos taurus; identical to SEQ ID NO: 28654

SEQ ID NO: 109585 - DNA, 201 bp, Bos taurus; identical to SEQ ID NO: 28655

SEQ ID NO: 109586 - DNA, 201 bp, Bos taurus; identical to SEQ ID NO: 28659

SEQ ID NO: 109587 - DNA, 201 bp, Bos taurus; identical to SEQ ID NO: 28660

SEQ ID NO: 109588 - DNA, 201 bp, Bos taurus; identical to SEQ ID NO: 28662

SEQ ID NO: 109589 - DNA, 201 bp, Bos taurus; identical to SEQ ID NO: 28663

SEQ ID NO: 109590 - DNA, 201 bp, Bos taurus; identical to SEQ ID NO: 28664

SEQ ID NO: 109591 - DNA, 201 bp, Bos taurus; identical to SEQ ID NO: 28665

SEQ ID NO: 109592 - DNA, 201 bp, Bos taurus; identical to SEQ ID NO: 28666

SEQ ID NO: 109593 - DNA, 201 bp, Bos taurus; identical to SEQ ID NO: 28668

SEQ ID NO: 109594 - DNA, 201 bp, Bos taurus; identical to SEQ ID NO: 28669

SEQ ID NO: 109595 - DNA, 201 bp, Bos taurus; identical to SEQ ID NO: 28670

SEQ ID NO: 109596 - DNA, 201 bp, Bos taurus; identical to SEQ ID NO: 28674

SEQ ID NO: 109597 - DNA, 201 bp, Bos taurus; identical to SEQ ID NO: 28675

SEQ ID NO: 109598 - DNA, 201 bp, Bos taurus; identical to SEQ ID NO: 28676

SEQ ID NO: 109599 - DNA, 201 bp, Bos taurus; identical to SEQ ID NO: 28677

SEQ ID NO: 109600 - DNA, 201 bp, Bos taurus; identical to SEQ ID NO: 28681

SEQ ID NO: 109601 - DNA, 201 bp, Bos taurus; identical to SEQ ID NO: 28684

SEQ ID NO: 109602 - DNA, 201 bp, Bos taurus; identical to SEQ ID NO: 28687

SEQ ID NO: 109603 - DNA, 201 bp, Bos taurus; identical to SEQ ID NO: 28688

SEQ ID NO: 109604 - DNA, 201 bp, Bos taurus; identical to SEQ ID NO: 28689

SEQ ID NO: 109605 - DNA, 201 bp, Bos taurus; identical to SEQ ID NO: 28691

SEQ ID NO: 109606 - DNA, 201 bp, Bos taurus; identical to SEQ ID NO: 28694

SEQ ID NO: 109607 - DNA, 201 bp, Bos taurus; identical to SEQ ID NO: 28695

SEQ ID NO: 109608 - DNA, 201 bp, Bos taurus; identical to SEQ ID NO: 28701

SEQ ID NO: 109609 - DNA, 201 bp, Bos taurus; identical to SEQ ID NO: 28704

SEQ ID NO: 109610 - DNA, 201 bp, Bos taurus; identical to SEQ ID NO: 28705

SEQ ID NO: 109611 - DNA, 201 bp, Bos taurus; identical to SEQ ID NO: 28706

SEQ ID NO: 109612 - DNA, 201 bp, Bos taurus; identical to SEQ ID NO: 28707

SEQ ID NO: 109613 - DNA, 201 bp, Bos taurus; identical to SEQ ID NO: 28708

SEQ ID NO: 109614 - DNA, 201 bp, Bos taurus; identical to SEQ ID NO: 28710

SEQ ID NO: 109615 - DNA, 201 bp, Bos taurus; identical to SEQ ID NO: 28711

SEQ ID NO: 109616 - DNA, 201 bp, Bos taurus; identical to SEQ ID NO: 28712

SEQ ID NO: 109617 - DNA, 201 bp, Bos taurus; identical to SEQ ID NO: 28713

SEQ ID NO: 109618 - DNA, 201 bp, Bos taurus; identical to SEQ ID NO: 28714

SEQ ID NO: 109619 - DNA, 201 bp, Bos taurus; identical to SEQ ID NO: 28718

SEQ ID NO: 109620 - DNA, 201 bp, Bos taurus; identical to SEQ ID NO: 28720

SEQ ID NO: 109621 - DNA, 201 bp, Bos taurus; identical to SEQ ID NO: 28721

SEQ ID NO: 109622 - DNA, 201 bp, Bos taurus; identical to SEQ ID NO: 28722

SEQ ID NO: 109623 - DNA, 201 bp, Bos taurus; identical to SEQ ID NO: 28724

SEQ ID NO: 109624 - DNA, 201 bp, Bos taurus; identical to SEQ ID NO: 28725

SEQ ID NO: 109625 - DNA, 201 bp, Bos taurus; identical to SEQ ID NO: 28726

SEQ ID NO: 109626 - DNA, 201 bp, Bos taurus; identical to SEQ ID NO: 28727

SEQ ID NO: 109627 - DNA, 201 bp, Bos taurus; identical to SEQ ID NO: 28728

SEQ ID NO: 109628 - DNA, 201 bp, Bos taurus; identical to SEQ ID NO: 28729

SEQ ID NO: 109629 - DNA, 201 bp, Bos taurus; identical to SEQ ID NO: 28730

SEQ ID NO: 109630 - DNA, 201 bp, Bos taurus; identical to SEQ ID NO: 28731

SEQ ID NO: 109631 - DNA, 201 bp, Bos taurus; identical to SEQ ID NO: 28732

SEQ ID NO: 109632 - DNA, 201 bp, Bos taurus; identical to SEQ ID NO: 28733

SEQ ID NO: 109633 - DNA, 201 bp, Bos taurus; identical to SEQ ID NO: 28734

SEQ ID NO: 109634 - DNA, 201 bp, Bos taurus; identical to SEQ ID NO: 28735

SEQ ID NO: 109635 - DNA, 201 bp, Bos taurus; identical to SEQ ID NO: 28736

SEQ ID NO: 109636 - DNA, 201 bp, Bos taurus; identical to SEQ ID NO: 28737

SEQ ID NO: 109637 - DNA, 201 bp, Bos taurus; identical to SEQ ID NO: 28738

SEQ ID NO: 109638 - DNA, 201 bp, Bos taurus; identical to SEQ ID NO: 28743

SEQ ID NO: 109639 - DNA, 201 bp, Bos taurus; identical to SEQ ID NO: 28750

SEQ ID NO: 109640 - DNA, 201 bp, Bos taurus; identical to SEQ ID NO: 28751

SEQ ID NO: 109641 - DNA, 201 bp, Bos taurus; identical to SEQ ID NO: 28752

SEQ ID NO: 109642 - DNA, 201 bp, Bos taurus; identical to SEQ ID NO: 28753

SEQ ID NO: 109643 - DNA, 201 bp, Bos taurus; identical to SEQ ID NO: 28757

SEQ ID NO: 109644 - DNA, 201 bp, Bos taurus; identical to SEQ ID NO: 28759

SEQ ID NO: 109645 - DNA, 201 bp, Bos taurus; identical to SEQ ID NO: 28760

SEQ ID NO: 109646 - DNA, 201 bp, Bos taurus; identical to SEQ ID NO: 28761

SEQ ID NO: 109647 - DNA, 201 bp, Bos taurus; identical to SEQ ID NO: 28762

SEQ ID NO: 109648 - DNA, 201 bp, Bos taurus; identical to SEQ ID NO: 28764

SEQ ID NO: 109649 - DNA, 201 bp, Bos taurus; identical to SEQ ID NO: 28765

SEQ ID NO: 109650 - DNA, 201 bp, Bos taurus; identical to SEQ ID NO: 28766

SEQ ID NO: 109651 - DNA, 201 bp, Bos taurus; identical to SEQ ID NO: 28767

SEQ ID NO: 109652 - DNA, 201 bp, Bos taurus; identical to SEQ ID NO: 28768

SEQ ID NO: 109653 - DNA, 201 bp, Bos taurus; identical to SEQ ID NO: 28769

SEQ ID NO: 109654 - DNA, 201 bp, Bos taurus; identical to SEQ ID NO: 28770

SEQ ID NO: 109655 - DNA, 201 bp, Bos taurus; identical to SEQ ID NO: 28771

SEQ ID NO: 109656 - DNA, 201 bp, Bos taurus; identical to SEQ ID NO: 28772

SEQ ID NO: 109657 - DNA, 201 bp, Bos taurus; identical to SEQ ID NO: 28773

SEQ ID NO: 109658 - DNA, 201 bp, Bos taurus; identical to SEQ ID NO: 28774

SEQ ID NO: 109659 - DNA, 201 bp, Bos taurus; identical to SEQ ID NO: 28775

SEQ ID NO: 109660 - DNA, 201 bp, Bos taurus; identical to SEQ ID NO: 28776

SEQ ID NO: 109661 - DNA, 201 bp, Bos taurus; identical to SEQ ID NO: 28777

SEQ ID NO: 109662 - DNA, 201 bp, Bos taurus; identical to SEQ ID NO: 28778

SEQ ID NO: 109663 - DNA, 201 bp, Bos taurus; identical to SEQ ID NO: 28779

SEQ ID NO: 109664 - DNA, 201 bp, Bos taurus; identical to SEQ ID NO: 28780

SEQ ID NO: 109665 - DNA, 201 bp, Bos taurus; identical to SEQ ID NO: 28781

SEQ ID NO: 109666 - DNA, 201 bp, Bos taurus; identical to SEQ ID NO: 28782

SEQ ID NO: 109667 - DNA, 201 bp, Bos taurus
aaccatcttagtagtcaccaatgggttgatatgaagtggcacagcttttaaatctagttctaaccttaccagatgagatactaatatgctgggaaggccattgagacactttaggaaatgaagcaggcagccacatcacactgctgccttgctttggtgagttaatccatcatgtgtagctgcttttctaatagtacacca

SEQ ID NO: 109668 - DNA, 201 bp, Bos taurus
acttgattcaggccaactgggacctcatgacccaccctccccccaaagttggactcacgatgtctggtaatcacctttctcttctagagcagcagtcagctgtgccctgaaactccacagggaatgttctccaagacctcctgggcagctagcatctgtgtcatttaaacatcaccaaggtcttcccaagaccacagcttc

SEQ ID NO: 109669 - DNA, 201 bp, Bos taurus
ttattaggagaggacaaattcaaacatacacaaaagcattttgcctttttctcactttggtccaagatgaaggcaggtgataaaacagtgtgagctaaatccattttgaaagaggagtcttattgagtgatcctagacagacaaagggatcaagacctgttcatattaaataaatgctatttataaccaagccctttgaac

SEQ ID NO: 109670 - DNA, 201 bp, Bos taurus; identical to SEQ ID NO: 28783

SEQ ID NO: 109671 - DNA, 201 bp, Bos taurus
tgtactttccgcattgagttcccattgctcttttgtcagaaccagttgagtgtatgtatgtgtgtgggcctcctttgagctcactgttctgttttgttgacctgtgtgtctgttcttttgccagtaacatactgtgttaattattgccttgttatgtcttatactaagtcttgtgttgtataataaagaattcagctgact

SEQ ID NO: 109672 - DNA, 201 bp, Bos taurus
gtcagtctaaatctagtggattttgaaatctgcagtggattttattctttctttgcttatagaactaaataagagccctttttgtgttcacagaaaattcctttttggcagcttctgaaagtccttttccaacttcttctgatttcaactgcagttgttgtagtttatgacacacgatccccaaatatggcatcttggcat

SEQ ID NO: 109673 - DNA, 201 bp, Bos taurus; identical to SEQ ID NO: 28785

SEQ ID NO: 109674 - DNA, 201 bp, Bos taurus; identical to SEQ ID NO: 28786

SEQ ID NO: 109675 - DNA, 201 bp, Bos taurus
tcatccgtcagcgctgcatactccaccacggccacatcccacagaaaggcgtagttccccttctttgcctgaaagagcaaaatcaccttgcggttaggcaaacctggcctcccgtaatagttttgagcagcgagaaatctcaatggctggatttggggaccctcctgaacggtcctcctgcccaatcagctggcacagcaa

SEQ ID NO: 109676 - DNA, 201 bp, Bos taurus
ccctctgttagttagctggcctctctgagcctcagtttccaagtccttaaataaaaaacaaaacacaacacacacaaacacaggattagaagtagagcccgtagcagaggttgctgtgaagatgaaatgaggtgacgtgtgttcagtccttagagcagggactgatgcaaactcagtggccgtcaccaggagcaggtgttc

SEQ ID NO: 109677 - DNA, 201 bp, Bos taurus
ctcaggaacacagagctttgatgagctgtcaggtaatggtaagcaaggctcttaatatcccagatcctctatttccacttcagtgaagtgggaataaattagtacccacctcctagaaagctgggatgataatgagattatgaaccataatagcattatatttataatacatttactagcgagtttagcacatagtagttt

SEQ ID NO: 109678 - DNA, 201 bp, Bos taurus
caccaccaccaggggctcagaaagaaacacacaggcctttgaggtgcaagtccacgagccatgccctgtcctgtgacccatggggaagaccttatttggagacctccttggccagtgctgtttacaaggtggcatcctgaaatagggtggcagaaagagaaatgatagtttgctctctcccctggtggggccaccacggga

SEQ ID NO: 109679 - DNA, 201 bp, Bos taurus; identical to SEQ ID NO: 28791

SEQ ID NO: 109680 - DNA, 201 bp, Bos taurus
gattggaagtatacccctttgcctcgcctgttcgtccctggctccaaagttcatctgatcagctctattgcttcctgggaggcctctcttcttggtaggcggggtgtgaaaaaccttctttccctggcataactcgaaacaacttcccttgaagctcttccctccatcagcctgggaaggccggctggggttcagctgtgg

SEQ ID NO: 109681 - DNA, 201 bp, Bos taurus; identical to SEQ ID NO: 28792

SEQ ID NO: 109682 - DNA, 201 bp, Bos taurus
ccctacccatcaaagcccatcaaggtctcacaccctccacagggccaaccccaagcaaaggtctctctctgactgatgtctcgaggtcttctctgagacacaccaggagcgctgtccacctggccctcccgtacataaatgacaggaaccaagataacacaggctgaagagagtcctgactcttggtctgaactgagcata

SEQ ID NO: 109683 - DNA, 201 bp, Bos taurus; identical to SEQ ID NO: 28793

SEQ ID NO: 109684 - DNA, 201 bp, Bos taurus; identical to SEQ ID NO: 28794

SEQ ID NO: 109685 - DNA, 201 bp, Bos taurus; identical to SEQ ID NO: 28795

SEQ ID NO: 109686 - DNA, 201 bp, Bos taurus; identical to SEQ ID NO: 28796

SEQ ID NO: 109687 - DNA, 201 bp, Bos taurus
agagtctttagccactgaaccaccagggaagtccctgtccattttaaaaatcggttgttcatttttcattattgagttttgagagttctttacatcttatgtatgcttatcagatatacgctatgtaaatatctctcccagtctgcgccttttcttttcattctattaacagtgtgtttgtaagagcagaagtgttcagtt

SEQ ID NO: 109688 - DNA, 201 bp, Bos taurus
cagtccccatgagtctgagcaggttcagggaatggctgtgcctggcccagcggccagctgcagggaagggctgcagtctccagcccaagaggaactccagcggggagaaggtcttgtgtgtgcctgatctgagagaggaagctggctgggtgttgtggcttggctgaagccacaaaggagaagcttctgggttgagaccac

SEQ ID NO: 109689 - DNA, 201 bp, Bos taurus; identical to SEQ ID NO: 28797

SEQ ID NO: 109690 - DNA, 201 bp, Bos taurus; identical to SEQ ID NO: 28799

SEQ ID NO: 109691 - DNA, 201 bp, Bos taurus; identical to SEQ ID NO: 28801

SEQ ID NO: 109692 - DNA, 201 bp, Bos taurus; identical to SEQ ID NO: 28803

SEQ ID NO: 109693 - DNA, 201 bp, Bos taurus; identical to SEQ ID NO: 28805

SEQ ID NO: 109694 - DNA, 201 bp, Bos taurus
aaagaagtttggcatccatgcaggagtgagtaggccgggttaggagggaagggacaggttagtgggtagctggctgccccagtgcaggagaagatatggtatctgggccaggagaaggggtgatcttgatggaggagggagataaccctgagaaactcattggattggggtgagaagtgagtggaaggggcagagacaaag

SEQ ID NO: 109695 - DNA, 201 bp, Bos taurus
tctctctgttattcctcattccagttcttgatactggtgttcggtaaactttccctcttctcatcggaaacctgacgctctttgactgtaggagggccggcgtccccgctctgcccgctggtgcgcgcgcgcttccctgcgtcggtctcctcttccctagctgtgcgctcctcatcggaacgctgcttcaggcgctgctgt

SEQ ID NO: 109696 - DNA, 201 bp, Bos taurus
ctgccacggcccaccgcgtcccgctcccagccacagccctgcccatttgccgccttaactgggctgaacccctggccctgctctcagtccattctgttgtcagggattatctcctgtaccattttttcataaaaccaaaatcactaccatcaaatggcctttgtacctttaaaaaggtctgcttaaaattctgtttttaaa

SEQ ID NO: 109697 - DNA, 201 bp, Bos taurus
tgcatttcactcatttaaagcatatgtgtcaatggtgtttagtaatgtaatgttcagagagttctgagactttcaccacagtcaatttcagaatattttcttcactccattagccgtcacttcccattggtggtggtggtttagtcgctaagttgtgtctgactcttgcgatcccgtggactgtagcctgtcaggctcctc

SEQ ID NO: 109698 - DNA, 201 bp, Bos taurus; identical to SEQ ID NO: 28807

SEQ ID NO: 109699 - DNA, 201 bp, Bos taurus
gtgaatttaaacaatagttgtaataaggtgtgggagaaggagagtaagaaggatacaaacgtgagcctgcatttaaggtttcagccgtgaggcatttctcgttgtttgtcagggttggcccttggtacagatgtctggagttggatacagctgagcggcaagacgattgtgagttccatgagttggatcacccctccaaac

SEQ ID NO: 109700 - DNA, 201 bp, Bos taurus
cccccaaggccagagattcgggactccagaggcttgtccccaccgagcaagcgccccttggatggacgccgggacagaatccactccactgtcagattacgagggaaagaacagacggaggtggccggggaggcttgtgatcactagagaggatcaaaagggcacttttctcacccccgcgccttccagaccgcctgcttg

SEQ ID NO: 109701 - DNA, 201 bp, Bos taurus; identical to SEQ ID NO: 28809

SEQ ID NO: 109702 - DNA, 201 bp, Bos taurus; identical to SEQ ID NO: 28810

SEQ ID NO: 109703 - DNA, 201 bp, Bos taurus; identical to SEQ ID NO: 28812

SEQ ID NO: 109704 - DNA, 201 bp, Bos taurus; identical to SEQ ID NO: 28813

SEQ ID NO: 109705 - DNA, 201 bp, Bos taurus; identical to SEQ ID NO: 28814

SEQ ID NO: 109706 - DNA, 201 bp, Bos taurus; identical to SEQ ID NO: 28815

SEQ ID NO: 109707 - DNA, 201 bp, Bos taurus
ttggaatgttccagtgctgaccagttgctatgggcctgttggcgggggaggggcattggtggaactccagtgtttgtgaagtcttccatttccttggtaggggaacttgagacagcggggtggccagaggggagcagtcacagttgggctctaaagctagaactcagctagtggcctcgatccggcctgggctgcttgctg

SEQ ID NO: 109708 - DNA, 201 bp, Bos taurus
cacaaggccagatttcaatcgttcactgatccattcttctttttattcaaccagcattcactgaagactttccccctgacgttgggaagtattggtgacacgttaataaggcaccactcggcccttgttccccatgtgggggagagtgacaagctatgagacaaatcggcccaagtgcagctggaactacctgttctgact

SEQ ID NO: 109709 - DNA, 201 bp, Bos taurus
aataaggatgttcgtacttgcctaaagtgaaagaaaagagttttttcccagtaacaaagttttaattaaaacataacctatgaggataaatagtcaagtattgaaatccacttcaacttctctgaatgaacgttaaaccgcattcaaggtggtagaaagagaaaacttgcaggcttaagccaccctgaaaggaatttaaga

SEQ ID NO: 109710 - DNA, 201 bp, Bos taurus
ttaaatgactgaattgacacatttttgcattccaaagtgacttttgaaccttgtatgagttaagggaagttctccaaatcatgttctccaagagttttcatcctggaaccactttacatgggccacaatctgcatgagcaaaagggaccttctgcgctatgccctcaatgtccaggaagctagtgaccggactctaggacc

SEQ ID NO: 109711 - DNA, 201 bp, Bos taurus
ggggtaaggatggggaaagaatttgaaaatctcagtcttcatatgcacacacgatttttaaaattaacaaagaacctaggttgtctttggttttaaattacggctccagcatcacccagccctcagggtcatggtttatggttcttcctggctgcctcaggcaaggcgaaggaacttcagtgctgaaggtgcttcctgtct

SEQ ID NO: 109712 - DNA, 201 bp, Bos taurus
ctctcctgccaatcagcatttcacataaccagagcaccagtcagaaatatgtcagatgagaagagatgagaaggaggcctagtaaatgcagctaccttttagagtcctgccttctaaaataatttctcttatagcagttcagggaccctcctgagcaatggcctttacaggaagctgaccactctggctaaaccacagttt

SEQ ID NO: 109713 - DNA, 201 bp, Bos taurus; identical to SEQ ID NO: 28817

SEQ ID NO: 109714 - DNA, 201 bp, Bos taurus; identical to SEQ ID NO: 28818

SEQ ID NO: 109715 - DNA, 201 bp, Bos taurus; identical to SEQ ID NO: 28819

SEQ ID NO: 109716 - DNA, 201 bp, Bos taurus
aagagtatggagttatagcagcaaaattggttttacatgctgtgctcagacaaaagcaaggcagggaagcaggtgccagggcttggtgagaaatggcctcgtacccaggcagcttgtccttctgtgttcatgtctctactgctcaggaacattctcaaaaatctgaatgttctggaagtaaatcatgattagtcggttagg

SEQ ID NO: 109717 - DNA, 201 bp, Bos taurus; identical to SEQ ID NO: 28820

SEQ ID NO: 109718 - DNA, 201 bp, Bos taurus
tatttctcgcctctctcctcctaatcgtcttcctggctgtaacatttccagtctctttcctcaaactccctcccctgttgactacggcttatatcaggctgttggaacattctggccagcccactattcctcttccctgaggtgaggggagaggcctggggcagctggagaggggccagttctccttgctcatctgggata

SEQ ID NO: 109719 - DNA, 201 bp, Bos taurus; identical to SEQ ID NO: 28821

SEQ ID NO: 109720 - DNA, 201 bp, Bos taurus
cagagccaccaaaaattcccaggtgggtgtgaccagtattccatttattagaagaaacaacatggggtatagcaaccagctacaaggtgaatgggcattacaaaggaaaagaaggtcaaaggtaactctataggggcactgcaggcccaaagaggcatgcctgcatttcagaagtggctttgaccagaatgagtctcaagt

SEQ ID NO: 109721 - DNA, 201 bp, Bos taurus; identical to SEQ ID NO: 28822

SEQ ID NO: 109722 - DNA, 201 bp, Bos taurus
gtctggaacctaatagattctcacatttttggtggcactaacgttggctgcattggaatggctggccagactgtgtgggcatgggttgcagtgttttcctgtctctgcatttttcacctagcatctggcattggacttgcactgtaggtagggcttcaaatttcttggacacttgttcaatgaaatcaataagacttatga

SEQ ID NO: 109723 - DNA, 201 bp, Bos taurus
caatattttgtcatacattaatttacatatttgtttaaggccatgttaaataaattacattaaagtcaaacagattatcggcttgttcttcagtctatacgaaagtttcttaacttggccattattaacattttggacagaatagttcttgcctgtgaaggcttgtcctgggcacagtaggatgtttagcagaaccctggc

SEQ ID NO: 109724 - DNA, 201 bp, Bos taurus; identical to SEQ ID NO: 28823

SEQ ID NO: 109725 - DNA, 201 bp, Bos taurus
tcagatttttaaattaaggatgaaagatagttggaaatttaaaagggtgtataagacatttcatggcgatagtaacaaactgatggagaatatttaggttgtatactgcaatgtcccatgactggaacttgtgtatagttattttcagctttacctggattaatacaaaatgtatcagttgtgatcagaattggttacata

SEQ ID NO: 109726 - DNA, 201 bp, Bos taurus
gctggacaccaaaatctgttgggaacagtgaagtggtaattttaatgaagtgctgaaggctgagtgcagactaacacgagaatgggagactctagggaacgtcaagcccaagggacccctgcactgccatttgcttccgctctagtgaaacccaccagctgtagccgggaaacagagtgggttagcagagaacagcagcag

SEQ ID NO: 109727 - DNA, 201 bp, Bos taurus
agccagatattagataatgctacagaattatgtcatgtattagagaatggcacagatattgaaatgcagtagagattgttttattaaacattggagaggcaatttatgagtagaaataagaaatatgagaatatgtgtatcaattaagacaatatttattcagtaatattgacagagcatctgctattaatatatgtaaag

SEQ ID NO: 109728 - DNA, 201 bp, Bos taurus; identical to SEQ ID NO: 28824

SEQ ID NO: 109729 - DNA, 201 bp, Bos taurus
agccaggcacaaacctttatcagcccatttaacacagcatcctcagtgccccactggtgggccacacacacgttgcagtctctgtaggttgtgcaatgtacagacattcacataagctacctgtgagtgcgccccctgcaattgaagagtgtcattttcctttctttactcaccatgctgctgctaagtcacatcagtcgt

SEQ ID NO: 109730 - DNA, 201 bp, Bos taurus
cctttgaaccaacctcttcccaatttctgcaaacttgtttttcactttgcatttctatgtgaaccaagttcctacccacatcccagattgtcaaaaccagaacttgagctatcataaatatcctcttccctcactatttccaatttataatcatcatccggtattatctaattttacctctccatatatttcttcacctaa

SEQ ID NO: 109731 - DNA, 201 bp, Bos taurus
caaaaatataaaccagatgttggagttaccagacaaggatgtttaaacaagtataaaatgattcaacaagcaatgttaaagtcacttgaaatgacaacaaccaacataaaatctcagcaaataaacagatgtttgaaaagagaaccaaagaaattatatagttgaaaactcaaacaatagaaaggaaaaatgaaaaatctt

SEQ ID NO: 109732 - DNA, 201 bp, Bos taurus
ctctttggcaaggtcactcatagtctccaagaggaaacagggcatgtagcatattcatctgttaacatatggccccatacattttaattttttgcatatgtaattctgttgcaaatagcagaaatatagttaacttcaaaagaaaggggtgcatttcccaaagatgacacagtctatagtgtgaagcaaacacgctcatga

SEQ ID NO: 109733 - DNA, 201 bp, Bos taurus; identical to SEQ ID NO: 28825

SEQ ID NO: 109734 - DNA, 201 bp, Bos taurus
aaaagaagataggattacaccactgaacagcattttctaacctgtgctcaaatggtctcttctaattactttgttactcagtgtagcccatttgtttctcttactaaatgtgaaatgttgagcttagtctattactttagctacattttagaaaatcttatcaatgatggaataatacttgtttatatgaagtctttattc

SEQ ID NO: 109735 - DNA, 201 bp, Bos taurus
gttcagtgcagttgctcagtcatgtccaactcttcgtgaccccaatagatatgttaatatgtgtaaaaagtgtgcaaacacttgtgttcagcaaaggttagcatggcaggcctgaggctgctgtttttcttatgaagtccttctggcaggattggccatctggaaacctaaatttcaggagcattcccaccaccctaactg

SEQ ID NO: 109736 - DNA, 201 bp, Bos taurus; identical to SEQ ID NO: 28826

SEQ ID NO: 109737 - DNA, 201 bp, Bos taurus
tgacagaggccagtcggaaggcagtggcttcctgccaccgttttgattccctacgtgtttcattgttctgagtcccgtgagactgagctagagctcatctgctggccttttgaggcagccaagaaatcattgtcgtgggttctatgcagccccccaccctacccccgtggggagctcagcttaggctttctgcagaatctt

SEQ ID NO: 109738 - DNA, 201 bp, Bos taurus
gtgtttcacatgtaggcctctaatctgttgaattcatttctgtttaaggaaatggtttaggttgaggtccatttttctgcttatgagtgtctgtttactctagcatcatttgtcaaaaggccatccttcctctactgaattgcttttgcatttctgtcaaaaatttattggacatatttgtgtggttctatttctgaatat

SEQ ID NO: 109739 - DNA, 201 bp, Bos taurus
atttcacaggccatctgtataatacaaaatagtctccccatctcaatataattaatttagtcacatctgcaaaaaaaacccttttataaggtgatacttatgtgttgtaggtaccaggcccttgactcctttagatcatgattctgtttaccatggacttccctcatggcttagccggtaaggaatctgcctgcaatgcag

SEQ ID NO: 109740 - DNA, 201 bp, Bos taurus
atctggcttctgtctttacctctccaccaaaactccccaatcgtgttgccagattctaaaaacaattttaaatcctgtgtcctctgctagatctgacatcaccagctgtcttgtttcttgtaaagctcttgcctttcttggctttgtggtagcactgcactcgccctcactactctccataggcattctcttccctctaca

SEQ ID NO: 109741 - DNA, 201 bp, Bos taurus
aagaaggagagtttgaggcaaactaggtttctagttttctagtcttccaagcttggaagactagaaaaatggaagaatggagctgagaaaatacaaggccagttcagataatggaaagtaaacttgtttcaaccagggtggaaatgtcatatggaacaacagataaggctgggccgtgaaagtgggaaaagatgtcttaag

SEQ ID NO: 109742 - DNA, 201 bp, Bos taurus
cctggccacttgccctgtctgctctgccttatttctctctgttccttgggatgcacactttgtgcaggctacgccaccctctttctgttggagaagcatgtgtaactccctgttttgctaggcctttgcttatcccctctctggcttccctttctaaatattgtccaggcaccagcttgaaagcccacctcctgctccaca

SEQ ID NO: 109743 - DNA, 201 bp, Bos taurus
taaaagagatcccagaggccttatttgtcctttctgccatgtgaggtcacagtaaaaagatggccaccaatgaacccagaagtgggggcccaccagatcacggaacttcctagcttctagagctatgagaaataagtttctttgtttataagtcatccagtgtatgatattctgttgtagcagctcaaaaggactgtgata

SEQ ID NO: 109744 - DNA, 201 bp, Bos taurus; identical to SEQ ID NO: 28828

SEQ ID NO: 109745 - DNA, 201 bp, Bos taurus; identical to SEQ ID NO: 28829

SEQ ID NO: 109746 - DNA, 201 bp, Bos taurus; identical to SEQ ID NO: 28830

SEQ ID NO: 109747 - DNA, 201 bp, Bos taurus
gacaacttgcatgcctacaggcttgactctgtgaggccgagggaaagctgcttgttccatcacaggttctaggtacggagaactctgccaagggtcttggcggtggggcccgggggccagacggtcatctcagtccactctattgcaggcacagcctctgtggccgtggcagggatcctggctgctctgcggatcaccaag

SEQ ID NO: 109748 - DNA, 201 bp, Bos taurus
catcataggtaggaggagggggcggcccactgctcagcccagctaattctcttgacttgcaggcggagactgaggctcaacaagggggcttcagcaacccatggagatgcagctctttcccctcacatccaattcagtgcttttattgagttattgacttattgctgcatgtgaaccatagaacggaggcaccacgctggg

SEQ ID NO: 109749 - DNA, 201 bp, Bos taurus; identical to SEQ ID NO: 28831

SEQ ID NO: 109750 - DNA, 201 bp, Bos taurus; identical to SEQ ID NO: 28832

SEQ ID NO: 109751 - DNA, 201 bp, Bos taurus
cgcttgggaaggggccggagagaaatttgcccctccactcccctagaagaccccccttgccagccgatgtttcgaggtgggggtgaagggggcgctgcgcgaaggcctggccccttttgtgcacgttcagtgcccggcagtgtctcccagaccagcaacccccgaccctcctgtctccgcgtcttagagaagccagaatcg

SEQ ID NO: 109752 - DNA, 201 bp, Bos taurus; identical to SEQ ID NO: 28833

SEQ ID NO: 109753 - DNA, 201 bp, Bos taurus
agcagaattttaattactatttggttataaagtttccagtgttatttttgaggcaaggacattgtacacttaatactcaatagcagccaagatactgtgagttagtgggactccttccctcaaaactggatagtttaaggtgatcttccagcttttggaacaaccatttctgacttcagccattcacttttatattccttc

SEQ ID NO: 109754 - DNA, 201 bp, Bos taurus; identical to SEQ ID NO: 28834

SEQ ID NO: 109755 - DNA, 201 bp, Bos taurus
ttcacctgtttctcccttccctataatatttcctctgtcatactatgtcctttattagtgaagagtattgtctaagctgtcagttctctgattatagttcagcataattacaactacgttaagcaattatttgttatgcatgttacctctagttgattgtgaggtgcttaaggggaggatacatgacttactgatcttgtc

SEQ ID NO: 109756 - DNA, 201 bp, Bos taurus
ctatgaacattttggtttgtgtcctgatgcgtatgtgtaagagtttatctataatatatactgagtagaagaaatgctggattacagaaaaaaaaaaaagggtgaattttacaagacaatacaagattattttctaaagtggtcatggcaattcagactcaccaggaataaatgttaccattcattcatagattttttcct

SEQ ID NO: 109757 - DNA, 201 bp, Bos taurus; identical to SEQ ID NO: 28836

SEQ ID NO: 109758 - DNA, 201 bp, Bos taurus; identical to SEQ ID NO: 28837

SEQ ID NO: 109759 - DNA, 201 bp, Bos taurus; identical to SEQ ID NO: 28838

SEQ ID NO: 109760 - DNA, 201 bp, Bos taurus; identical to SEQ ID NO: 28839

SEQ ID NO: 109761 - DNA, 201 bp, Bos taurus; identical to SEQ ID NO: 28840

SEQ ID NO: 109762 - DNA, 201 bp, Bos taurus
ttctcagctcctctgtatttgaatggtattaactagagaagagggcttctgcatgtggttgccattgcagtttctccgtactcatgtgctcagtcgtgtccgactctgcagccccatcaactcctctatcaactgccaggctcctctatccattgcagttttagtgctttttaatcctgtgaacattctgaagggtagatt

SEQ ID NO: 109763 - DNA, 201 bp, Bos taurus
gcagcgagacaggcctagagcatgcaaataggcctgttgtctaaaaccctttggcttccagataaattcaggaattgtcttttgagatttaacgtaactgtgtctgtacttgtagcaggccagttgctgaggaagcaaagactccatctttagaaacaggcagataaggttaaaattcccaatctattgttgactatggag

SEQ ID NO: 109764 - DNA, 201 bp, Bos taurus; identical to SEQ ID NO: 28841

SEQ ID NO: 109765 - DNA, 201 bp, Bos taurus; identical to SEQ ID NO: 28842

SEQ ID NO: 109766 - DNA, 201 bp, Bos taurus; identical to SEQ ID NO: 28843

SEQ ID NO: 109767 - DNA, 201 bp, Bos taurus; identical to SEQ ID NO: 28844

SEQ ID NO: 109768 - DNA, 201 bp, Bos taurus; identical to SEQ ID NO: 28845

SEQ ID NO: 109769 - DNA, 201 bp, Bos taurus; identical to SEQ ID NO: 28846

SEQ ID NO: 109770 - DNA, 201 bp, Bos taurus; identical to SEQ ID NO: 28847

SEQ ID NO: 109771 - DNA, 201 bp, Bos taurus; identical to SEQ ID NO: 28848

SEQ ID NO: 109772 - DNA, 201 bp, Bos taurus; identical to SEQ ID NO: 28849

SEQ ID NO: 109773 - DNA, 201 bp, Bos taurus
atactctgcaggcattttgtgtggaaaccaaaatgacctattaacttgtctatctactcatgtgctaggaggatatggccagatccccaaacagctagcacgtgggtgttgtctgtgcttagcaaatatttgcgaatcaactaagtgaagcagtgagcacacagaggccctgttctgaatttttcccatcaggggctggca

SEQ ID NO: 109774 - DNA, 201 bp, Bos taurus; identical to SEQ ID NO: 28850

SEQ ID NO: 109775 - DNA, 201 bp, Bos taurus
tatgtttccttagaattcgccctcttaaaggtttatgtgtacatgaaaattggtgcgaacaaaacttctcctttgatggttatgcattattataaccacccgcagataatcatgaccggcttcagtatagtgctgtttctgatggaacacttggcaagatagttctgtagctggaatcatcttgagagacttttaaagaca

SEQ ID NO: 109776 - DNA, 201 bp, Bos taurus; identical to SEQ ID NO: 28851

SEQ ID NO: 109777 - DNA, 201 bp, Bos taurus; identical to SEQ ID NO: 28852

SEQ ID NO: 109778 - DNA, 201 bp, Bos taurus; identical to SEQ ID NO: 28853

SEQ ID NO: 109779 - DNA, 201 bp, Bos taurus
atgatgtatgtagtagcactttgtgggctattgagctctataaagagaggacaggatgattattgctgttcctatgggtttattaataattactgatgaacttaaagccctaggatagagttgggaatgatatcccaaatttcaaatctagagaactcttggaaggagagaaggagagatagatgaagaattttattaaga

SEQ ID NO: 109780 - DNA, 201 bp, Bos taurus; identical to SEQ ID NO: 28854

SEQ ID NO: 109781 - DNA, 201 bp, Bos taurus; identical to SEQ ID NO: 28855

SEQ ID NO: 109782 - DNA, 201 bp, Bos taurus
ccactatgtctggaatctgataatattttaataaattgtagctgctcttacaccattaaccaatttggttcagaaactgtatgcaacacattttagccagtagtgtataacatgactcatctagctcaaaatggttttagatggcaacatgccattccattcttatgggggaggacaagcttcaatctacctatacacatc

SEQ ID NO: 109783 - DNA, 201 bp, Bos taurus; identical to SEQ ID NO: 28856

SEQ ID NO: 109784 - DNA, 201 bp, Bos taurus; identical to SEQ ID NO: 28857

SEQ ID NO: 109785 - DNA, 201 bp, Bos taurus
ttgatctcacatgtctggcacctagcttgaaatgttgcccgtctcactgtgttgagtacctggtcagcaagctgggcctcagttcccttatctctaaagcaggcattacaatgccagtcattcatataggtgtttaaagtatatgtagtggtagcagttttattttaggtggggcctctccttggagtttgaaaagtaatc

SEQ ID NO: 109786 - DNA, 201 bp, Bos taurus; identical to SEQ ID NO: 28859

SEQ ID NO: 109787 - DNA, 201 bp, Bos taurus
attcaccacatagtattggggtgcccaaaaagttcatttgggtttttctgcaccatcttgtggaaaacatctttattgaagttatctctgcctccttttcgcctatttctttcaaggtgatttaccctagcatatcagtcttggggaagaaaatccttcttcacagagcaagaatggaagggcagaaataattatgcttaa

SEQ ID NO: 109788 - DNA, 201 bp, Bos taurus; identical to SEQ ID NO: 28861

SEQ ID NO: 109789 - DNA, 201 bp, Bos taurus; identical to SEQ ID NO: 28863

SEQ ID NO: 109790 - DNA, 201 bp, Bos taurus
caggggcaaatttaagggccagaggactttaattaggactctgttacttaacctccttctttctcttactatatctgagtcatctgtgtggaaattcggagtgtcaagcatttggcagtaaaactccaaaagtcatgaaatgcctggagagataactgttgcattttgtttctttgtttgttttttttttttcattgctac

SEQ ID NO: 109791 - DNA, 201 bp, Bos taurus; identical to SEQ ID NO: 28867

SEQ ID NO: 109792 - DNA, 201 bp, Bos taurus; identical to SEQ ID NO: 28868

SEQ ID NO: 109793 - DNA, 201 bp, Bos taurus
agaccgagaagaaagaaggggccccggagcaggggggatgcagagcttagtgctcacatctgggggtctcttgtgaaaggctgagagcagagctattcagcggccccgtgtctgctgggtgttaccagtttgactgggatgccccatggggatttgggactgagtggtacaaacgtgagactagtgttaacaggcacctct

SEQ ID NO: 109794 - DNA, 201 bp, Bos taurus
attgattgtagtaatccaaattttctggattttccctcgatgacttgtgagggaaaaactctcccctagtcttttctcaggactttctgtgagactccaagggcctcacatgttctcaacaagaagtccgctctggtccctttacatcacactccttgttaacattctctcttcccacaagcccataggaaggcggcacca

SEQ ID NO: 109795 - DNA, 201 bp, Bos taurus
acagctaagggctcactgtgcatttgagcatcctccagaaaggggtgacgcagggaagtgtacatccttcacagtgcgcagaccaaggccaggaaggtgatgtgagttttcggagggcatcccccggtgagaaggaatcaggaacgcgttctcctcttaggccatctctgtctcataccagtcaagccactgaaagaggat

SEQ ID NO: 109796 - DNA, 201 bp, Bos taurus; identical to SEQ ID NO: 28869

SEQ ID NO: 109797 - DNA, 201 bp, Bos taurus; identical to SEQ ID NO: 28870

SEQ ID NO: 109798 - DNA, 201 bp, Bos taurus; identical to SEQ ID NO: 28871

SEQ ID NO: 109799 - DNA, 201 bp, Bos taurus; identical to SEQ ID NO: 28874

SEQ ID NO: 109800 - DNA, 201 bp, Bos taurus; identical to SEQ ID NO: 28875

SEQ ID NO: 109801 - DNA, 201 bp, Bos taurus
tttggttccattaggaccaagaaattgcaatttttggctctttactgcatggatttttccatgtgtgttttcagagacccttctgctgagatcttgactgcaactcttggtggattcaatgcctgtcttcctgtaccctctaaaatttctctgctgatgtcctttttattctccctgagtttggagccctttaaaaataca

SEQ ID NO: 109802 - DNA, 201 bp, Bos taurus
ccaaaacccaatacataggccagccccatagaatgtacaatgccaacagtgaacataccactctggtgggggatgctgataagggtgcaggctatgcatgtgaggccaggaggtgcatggggaaatctccacatcttactttcagtttggctgtgaacattaaactgctctaaaattttttaataaaaaatagccatcgta

SEQ ID NO: 109803 - DNA, 201 bp, Bos taurus; identical to SEQ ID NO: 28877

SEQ ID NO: 109804 - DNA, 201 bp, Bos taurus; identical to SEQ ID NO: 28878

SEQ ID NO: 109805 - DNA, 201 bp, Bos taurus; identical to SEQ ID NO: 28879

SEQ ID NO: 109806 - DNA, 201 bp, Bos taurus
aaaccttttgagtctttaccagagattggaagtgaggagtcccagtagtatgaaatctatttttttctagattctaccagataaacattaaaaaaaaactcatacttctgctaattaaatatattttattcccatatttgttaagctttctgtcatctatttttgtactttgacttaggacttattcatcattcaactcaa

SEQ ID NO: 109807 - DNA, 201 bp, Bos taurus; identical to SEQ ID NO: 28880

SEQ ID NO: 109808 - DNA, 201 bp, Bos taurus; identical to SEQ ID NO: 28881

SEQ ID NO: 109809 - DNA, 201 bp, Bos taurus
gcaaaattatttagagagaagtcttaaaaagtgaatttacattaatactaatttttatttggtttggttctatgcttattccataactttctgatcatccagtggtttttttccagattaatacaatttttttaactcattttatttttaagataatatgagatttaagaattagtgttatagtcttttatctattactaa

SEQ ID NO: 109810 - DNA, 201 bp, Bos taurus; identical to SEQ ID NO: 28884

SEQ ID NO: 109811 - DNA, 201 bp, Bos taurus
tcagatggaaacttgggtgcgaacctcccttgtctctcacagcctgtcactgcccctagcatccgccactccctccctgctctggagcctcaccagagggcgggtagggcctttgtggacttgcagagtaattcagggaatgagctgtggggaagcagccaccatcagccaccttgggttgcttctgaggtgctgcttgtg

SEQ ID NO: 109812 - DNA, 201 bp, Bos taurus; identical to SEQ ID NO: 28885

SEQ ID NO: 109813 - DNA, 201 bp, Bos taurus; identical to SEQ ID NO: 28886

SEQ ID NO: 109814 - DNA, 201 bp, Bos taurus
ggtataatatttattagtaattatattaataattaaaatcattaatgttaagtgtgcaattaaataactttatgacataaatagttatgtaacaatcaccgcattcacaaactggaacatttgccaaaactattccacacatttgaagtcaattcctttatctaatccactagcctctggcaattactgatattctctcac

SEQ ID NO: 109815 - DNA, 201 bp, Bos taurus
tcaatttctcatttctaaattgggaaagagagcactgttgagatggaggcccttttcagcaaaaccatgattgtttctgtttgtctgttagtagcgttgacgcttgccaggtgcaggacttaaggccccaccatcagtgagcttcactaatttcttttgtaaaattgggatgataattctttataggatttttgtgaggat

SEQ ID NO: 109816 - DNA, 201 bp, Bos taurus; identical to SEQ ID NO: 28887

SEQ ID NO: 109817 - DNA, 201 bp, Bos taurus
ataagggttctcctgtccactgcctttcaagccagtagaatgagattgagtttggttcaaagaatggagaggtgtgaactgatgcgctagagcacatactatcttgataggccattgtcagagttgcttttaagggttcttatcatcagggagtgggtagagtttacctggggcagacatatgctcaaatcccagagcccc

SEQ ID NO: 109818 - DNA, 201 bp, Bos taurus
agaaatgctgggaaggtaatggcctcagtggatagccttaggtgctatcagattaattgtcaagaacctgccaccttgacatcctgcccctggtctagctggagggcctaactacacagtccttgagtcccttagataaagcaatcccccaatctcttgattcagatggaacatagcaactctttgtccaggtttcactca

SEQ ID NO: 109819 - DNA, 201 bp, Bos taurus; identical to SEQ ID NO: 28888

SEQ ID NO: 109820 - DNA, 201 bp, Bos taurus
tgtgagcgggcctccagtcactaaccacgtcttcctgtgatcctgcacaggtcatatctgccaagactgtcacagacagagactagctcccctgaggagatgcatggcccccctggaactgtgcccttgtggcacatccaggagcctgagcagcttagacctgggacgtgcacaccgccgtgggtgtggcaaccccatgag

SEQ ID NO: 109821 - DNA, 201 bp, Bos taurus
gcgtgtccgaacacattcttgacatgcagttcaagcccgatgccgtgcccaggaatcatagtcacggagtgccatccgccatacatggctgctgggagagcgctgtgtttaaaagagaagctcctcagtgaggtctcattgccaaggaaaatctcccaagaatggcctagaatagctggtgggaacatggccttcacagag

SEQ ID NO: 109822 - DNA, 201 bp, Bos taurus; identical to SEQ ID NO: 28889

SEQ ID NO: 109823 - DNA, 201 bp, Bos taurus
acactttgcctgagtcagaactaggtactttcttactctccatttggaaccttaactgaatttagccaaaacatgggaaaggtttctgggaaaataaaaactgttggctgtaagccaaagccctctaagttcttatttcagactgcccttatttatcttatatgtatattactttttatatattctaactgcccagtattt

SEQ ID NO: 109824 - DNA, 201 bp, Bos taurus; identical to SEQ ID NO: 28891

SEQ ID NO: 109825 - DNA, 201 bp, Bos taurus
tttagctttggattttaagtgtattggtaagttatttgggagttttaagtgtaagagtaatagtaatctggctgttgtatgtaggatggactgcagaggtcctaaagtagaaaatggattaccagttagatagcgatcacaatccaagcaagaaatgatggtagagtagggatgtggctatgaaaatgctgagaagtgacc

SEQ ID NO: 109826 - DNA, 201 bp, Bos taurus; identical to SEQ ID NO: 28892

SEQ ID NO: 109827 - DNA, 201 bp, Bos taurus
ttgtactctatcccaaataacaatagaaataattctatataggtatctcctgcttttcaaaagttcactttacaccatgtcccttttaaaaaagacctacgttactatgttttccctaacagaaataaatttgaagaggatttttgcttttacaaaaaacggtgaaaagcaaaagtagcattcagtgtttgttctggagag

SEQ ID NO: 109828 - DNA, 201 bp, Bos taurus
tcccaacccagggatcgaacccaggcctcccacattgcaggcagacactttaacctctgagccaccaaggaagccctggtcctgccagaacactgatcaataggcctgatgtggtggaaagcgtgaactttgaaatcagacagaagatttgaatcttggccacttaaatagcttatgtgaccttgggcaagtccaggtaga

SEQ ID NO: 109829 - DNA, 201 bp, Bos taurus; identical to SEQ ID NO: 28893

SEQ ID NO: 109830 - DNA, 201 bp, Bos taurus
gaggcccacccacagggcagctgggggccaacagtactccccatgttcttcttatctttacagaaaatgggcacccagaacacaacagcccgcgagacacagagccaaactgcagcaaaggccttggagagggcaaagagccagctgcgtggggagaaggggcagaggggagacaaaggtgagggccaagccgcgtggtgg

SEQ ID NO: 109831 - DNA, 201 bp, Bos taurus
gagctgaccaccaccccagatgttctctaagacccctctaagcaggaacacttatgcaagtctacacccctagatctcctgctgaaatccctctgcaagaaaaaattcattcgccttgtggatttgagctccctctgtgtcctgctggggacagcccctgaatggactgtagactttctaggtgtcaggtgttatcctcaa

SEQ ID NO: 109832 - DNA, 201 bp, Bos taurus; identical to SEQ ID NO: 28894

SEQ ID NO: 109833 - DNA, 201 bp, Bos taurus
taaagacttaggaggagacagatggagaaagaaacagacgcaaagatgaaggcaaagaagaaggaggtgattttgcgacagagcctatgtggcccacaaaacctaaaacagtttctgtctggtgctttacagaagtttcagttcagttcagttcagtttagttgctcagtcgtgtccgactctttgtgaccccatgaactg

SEQ ID NO: 109834 - DNA, 201 bp, Bos taurus
ggcaatagcagccacagcttcccaggccctgttggggaactcgggctcctgggctgcccctgggggaactggtctggatcagggtaggggtgtggcctgctcgtggtgaatttgtctggatcagggcgccggtgcctctcgattctctgctatctggacaccaggactgaagtatcatcactcctactatctagagatagg

SEQ ID NO: 109835 - DNA, 201 bp, Bos taurus; identical to SEQ ID NO: 28895

SEQ ID NO: 109836 - DNA, 201 bp, Bos taurus; identical to SEQ ID NO: 28896

SEQ ID NO: 109837 - DNA, 201 bp, Bos taurus; identical to SEQ ID NO: 28897

SEQ ID NO: 109838 - DNA, 201 bp, Bos taurus
tctgtaaccaaggagcatccctgatttatttcttcacagagtccttcgtggagtatcaggttgtgatggcaaaaattcccagagaagaatgatgaggaagtaagtcattcaaggcctgggaaagctgagttcctttggagcctgccagcagcacctctccatcccagtaacctcccttgggagccatcggagcccttcttt

SEQ ID NO: 109839 - DNA, 201 bp, Bos taurus
ttaattcagagggtaaggctgatttcaagtgaggcgctggtgaggcccatggaaagaggggaacttgcaggcagtaaaggagacagatatgggtgcaattggcttgcccagttcaggcctccctcctctttccccagatcacccctgaactcctccccacttgactcccctctactccattaaaccctcaagctagagtta

SEQ ID NO: 109840 - DNA, 201 bp, Bos taurus; identical to SEQ ID NO: 28898

SEQ ID NO: 109841 - DNA, 201 bp, Bos taurus
gtatgttaatgacattaaatgctgagaagaaacacaaaggaaggaagggggttagggaatgttgcagatagtggttatgatggggagggcctgccaacattgccatgacatttgtgtccagaccttacaaaagtggagggagtaagccatgtgaatacatgagaaaagagttttccagatagagcaaatagtaagtacaaa

SEQ ID NO: 109842 - DNA, 201 bp, Bos taurus; identical to SEQ ID NO: 28899

SEQ ID NO: 109843 - DNA, 201 bp, Bos taurus; identical to SEQ ID NO: 28900

SEQ ID NO: 109844 - DNA, 201 bp, Bos taurus; identical to SEQ ID NO: 28901

SEQ ID NO: 109845 - DNA, 201 bp, Bos taurus; identical to SEQ ID NO: 28902

SEQ ID NO: 109846 - DNA, 201 bp, Bos taurus
acctcagaatagtagttttaagtaactttaaagcttgagctccttttgaatttcccaaagagtttctgcagtttctttcaaatgggcctcatcttcaggggtcagctttacctttacgaggtctgtagtgccattctctccaggacgcatggaacactaggtatagtcttcatttattcagtagtggccctgaaagtaaag

SEQ ID NO: 109847 - DNA, 201 bp, Bos taurus
gggcctggagaattccatggactgtatagtccatgggtttgcaaagagtcagacaggactgagtgactttcactttctcttgatagagcgttatttctctcgtataatcagttgaaacctttttactgttaactgccacagaattgaggtacctgctgtagaagaggaggactttggcagtcatgtaccactctttcacaa

SEQ ID NO: 109848 - DNA, 201 bp, Bos taurus; identical to SEQ ID NO: 28903

SEQ ID NO: 109849 - DNA, 201 bp, Bos taurus
tgtaatttcaagcagttagttttacttcagtctcttgatggtatatacaatgacaccaatatgtcttaagtaaagcaatattttgggccatgagttaactatcctatgctacatgaatttttgcttcactccaaaactatcttcagtttttttcagacattctaaaatgacagatttctagatcatttttctgaaactgtc

SEQ ID NO: 109850 - DNA, 201 bp, Bos taurus
aggaaagcaaactaaagtaaaacaagttaattaaactggaatgagaaagagaatgagagaatggaggtcaattataaatctgtgtattagacagtggtaagttgaaggccaggaaccagttccaggaaactattcactgaaatattaaagtcactgaaaaagagtaagcagtatacattctccttaaagatggaaaaagct

SEQ ID NO: 109851 - DNA, 201 bp, Bos taurus
aggttctgaagtttggttccattgattttaagagaatgcagccaacatgtattatctgatttgacttcaaaatcttttagaaatatagatcacaatttctttttatgcctttcagtccacccaagcagcagagaaaaacaaacattcttcattattattattttcatcacttggtaagtcacagaagacttagtgtaatat

SEQ ID NO: 109852 - DNA, 201 bp, Bos taurus
atcttttagaaatatagatcataatttctgtttatgactttcagtccactcaagcagcagagaaaaataagcattcttattattatttttgccacttggtggtcacagatttaatgtgagggtgatgctataatgtactcagttataaatgtggcagaagtttattcagtctcttccccagggaaacactctatgtataat

SEQ ID NO: 109853 - DNA, 201 bp, Bos taurus; identical to SEQ ID NO: 28904

SEQ ID NO: 109854 - DNA, 201 bp, Bos taurus
acagctgaattgcgctaagaagtttaaaacccagggaaaaactaaaaataaatccaaacgtcaaactaattaaatcaaaagttttaagatgggcctcgcccgcagcagtattttttaaagttcttcaggtggtcctgaagggcagccaaggttgaggaacacggttgcaggcagctaaaactccaggtcctgggcctcatt

SEQ ID NO: 109855 - DNA, 201 bp, Bos taurus; identical to SEQ ID NO: 28905

SEQ ID NO: 109856 - DNA, 201 bp, Bos taurus
ttgtatcaaaaataaaacttccagtaacatcctgaaggtaaaatgaagccaataatgtaaaagctattaatacgtattccattctatagtgtagaagcaccgccatattggccaccaggatcatgtgaccgtggtgttggcttctaggagttgtgtgatatacttgttcaagacttcatggttcaatcaggacttgtggaa

SEQ ID NO: 109857 - DNA, 201 bp, Bos taurus; identical to SEQ ID NO: 28906

SEQ ID NO: 109858 - DNA, 201 bp, Bos taurus; identical to SEQ ID NO: 28907

SEQ ID NO: 109859 - DNA, 201 bp, Bos taurus; identical to SEQ ID NO: 28908

SEQ ID NO: 109860 - DNA, 201 bp, Bos taurus; identical to SEQ ID NO: 28909

SEQ ID NO: 109861 - DNA, 201 bp, Bos taurus
ttttctctctggctgagacccctctccacaagaaagatcgggggccttcatttcctatcaaaggagagtcaccctgcagagcatcccctccagccactgtgtatcctttgttgaggattcagggcctggacgagagctggcctccctcctccacctgtgtgtctggcccagaactgcccctgctttccgtgaaacagcagc

SEQ ID NO: 109862 - DNA, 201 bp, Bos taurus
ctgtaggagttgatggccagaatcagcccagacctgcctcaggaggaaaggaattgagagcctgggatatagacatgggattcggtcaagtgtgattccaagaatatgtcgaacaggccaaatttatacaaatccgtttagaaatattccttcgaagtcttcccagaggttgacctgctgtcccttagaacgaacgtcttt

SEQ ID NO: 109863 - DNA, 201 bp, Bos taurus
acgaggctgcatggggtctataagttcaactatgtggtgggcttgtgcctttgtggggaacagaagcaggcacaggagagtgacatggcctctgaaatgcgttggggtacagtcatcacacctcatttagatagtgattgacatgatccgagtgcgatccggactggcagcatcgcatcccctgggagctgtttggagaca

SEQ ID NO: 109864 - DNA, 201 bp, Bos taurus; identical to SEQ ID NO: 28910

SEQ ID NO: 109865 - DNA, 201 bp, Bos taurus; identical to SEQ ID NO: 28911

SEQ ID NO: 109866 - DNA, 201 bp, Bos taurus; identical to SEQ ID NO: 28912

SEQ ID NO: 109867 - DNA, 201 bp, Bos taurus; identical to SEQ ID NO: 28913

SEQ ID NO: 109868 - DNA, 201 bp, Bos taurus
tgagagccgcttgtctccagcctggccctctctaacaagctctttttactcggggcttctctgagtagagacctcaaacaatagcagctttcaaggggctcggcccctcctccggcggcttccctctcccgcccctcggccctgctccgccctgctccctggcctctctgccttgtccacctgaacgtcccacccagtccg

SEQ ID NO: 109869 - DNA, 201 bp, Bos taurus; identical to SEQ ID NO: 28914

SEQ ID NO: 109870 - DNA, 201 bp, Bos taurus
agcccggggccaagaccagctcactccccaccggtcctgcgagatcatgctgtgatgtttaggacggagagtaggcacagtgcagcctgtgtctagctagtggtcaggccagatgggctggagtgggtatctgatctattaccactgcctcttcccctctctcttggcctgctctgtgacagtgaagttcccaacaattag

SEQ ID NO: 109871 - DNA, 201 bp, Bos taurus
caaaaacataatgctaactcgagaagccagacacaaaggccacttattttaagagtctatttgtatgaaatatccacacaaggcaaattcacggagacacgaggctgatcagtggttgcctgggcctggagatgggtgcagagactgacaacagatcttttctaggaaatgacttaatagtgggttatggccatggttgta

SEQ ID NO: 109872 - DNA, 201 bp, Bos taurus; identical to SEQ ID NO: 28915

SEQ ID NO: 109873 - DNA, 201 bp, Bos taurus
caggcttaggggggacccgccttgctaggaggccagcagggggtaggactctggtgcctgagccccagggagcgatgggatcacagggctgagatgggtccgtggcctcctttcgcaggaaaggaaaccaaggccatcaactcccctgatcacattttggtgtcagatcatgtcagtctgtgatggtcggggatgcactct

SEQ ID NO: 109874 - DNA, 201 bp, Bos taurus
ggaaggaaaatgaaataattgcattcggactcgcttgaaacaattcatctgtgtgtccacgaagatcctgagggcctgtggacactgcaaagtaacacgcaggtttgttctgtggtttctgcctccctgtgtgcctggcaggaacggggaaagggagtatctcggagcaggtggatttctactccccattgtgcaaagctg

SEQ ID NO: 109875 - DNA, 201 bp, Bos taurus
gctcccttggggccatgagagccgcgtgggcaggtggctccagcaaacaggccagggacacaccagcagctatagagcggcccagggcctctcctccgcctggaaggtgggctggcaaaggtcttggcagcccattctctttatctgatcccactactttccatctaccattcttttataaagcacaacttttcaggaatt

SEQ ID NO: 109876 - DNA, 201 bp, Bos taurus
gcctaccattttgccaagtcctgcttctcccaacttaaggatgcagatagaatcactaacaaaattacggatatttaaagcaaagatccgaaactctatcattaaaaatccttttccttggagacattaagcccacaggatatggtttggatggtggaatcagaaaaccagagctggcttcgtgtttctgaaactttgtct

SEQ ID NO: 109877 - DNA, 201 bp, Bos taurus; identical to SEQ ID NO: 28916

SEQ ID NO: 109878 - DNA, 201 bp, Bos taurus
tcttattttctgtttcctaagttgacttgagttacccttatgaagttatgagaatttatttaattagatttgtgtatgactcttatcaagaaacatatattaatattttttccttttggatatcaagagtgcacagaatttcaggaaattaagagtacacattggtgattttaagcacagatacaaaaagattggtattga

SEQ ID NO: 109879 - DNA, 201 bp, Bos taurus
acaactgttcacaaaaccatgtcttcctgcctctattgtatactacttggctctgaaatacatttgggggcaagtgaaccacaacagttcctccagtaagagagtgagcaaggtgagtgtgatcttatgtaacagtcacatcggaagcagctgggggaaacaagagcttggtataacccagaccagccacaggaaagatct

SEQ ID NO: 109880 - DNA, 201 bp, Bos taurus; identical to SEQ ID NO: 28919

SEQ ID NO: 109881 - DNA, 201 bp, Bos taurus; identical to SEQ ID NO: 28921

SEQ ID NO: 109882 - DNA, 201 bp, Bos taurus
agaagaaactgctaataaactccttaaaactgactcctaaggaatccccttagcctctctattttgcagaggcattataaaatttaaagaggaaagagacaacagctgaggatcccaaactcagtatccaaaaagagctccgctccaaatatattctgactctgagtcctctaccccatgcattcctcagtttatttaccc

SEQ ID NO: 109883 - DNA, 201 bp, Bos taurus
ttctcctttcattcactttccatccatagctgccaggcttgtgttctctacacccacagaaacactaggataaaggtggtcaatggccttcaatggccatatgcagtggactcattcactgattcagtcaacaaagctttgtgtcttctctgcatcagatgctgttcctggcctgcagatccagcaatgtaaaggctttct

SEQ ID NO: 109884 - DNA, 201 bp, Bos taurus
ttttgtttcttattgtagtaacattgctatacaacttggtgtgtgttgtaggtgaatccgagaggcaaggagttgaggccaaggaagagacttttaatccaggagtcagcaagttgagaagatggcaggctagcacctcaaaataaccattcttaccagggcctggttgccaggttcttttaaggatcagagatgagggga

SEQ ID NO: 109885 - DNA, 201 bp, Bos taurus; identical to SEQ ID NO: 28926

SEQ ID NO: 109886 - DNA, 201 bp, Bos taurus; identical to SEQ ID NO: 28928

SEQ ID NO: 109887 - DNA, 201 bp, Bos taurus
tgacactgccagtaccagcgtccctgtggcaggaagagctctcataaacggctgctcagtatccatgtcctgagtgagtcctctcgcctctggcctctcttggagcctctgtgggatcagcaggtgggtctaatccagctgcccttcaagcgactgcttcttccctgggccctggaaccgggagattctgtgtgtgcccct

SEQ ID NO: 109888 - DNA, 201 bp, Bos taurus
ctgcgcttggacaccccagccactctacgtggagcttcctgggaccctccacagtcaggctggggtgtctggatcatccaggagttttggaagaagcaggaaacaagtccaaaagggggaggctgaagagagattaaataaggactcagatagagtcacatgtttggcattaaggaaaagccttaggggatggagagacat

SEQ ID NO: 109889 - DNA, 201 bp, Bos taurus; identical to SEQ ID NO: 28932

SEQ ID NO: 109890 - DNA, 201 bp, Bos taurus
ccactgagctcagatgcagggttggaggaaggaaggtgtctttgaggtgagacttggaggtgagcgggtgagggcataaacagaacatctgctttcattacccgaaaacaaatttagtgccaataaaaggtgttcaagtgagaagactggggatggaaattgacagtcaaaaacacagccatacatgatcctaactttaag

SEQ ID NO: 109891 - DNA, 201 bp, Bos taurus
tatacatgtattatatatattgtaatatcttgttattatatatataaaacatgcttgtttttcaaagaattttctgtttcatcttggttgtcaaatttatcggcatacagattttattatacacccttatcatccatttgatgtctgtggaagctgtagtaatacccccattttctctctcttttggtaattgtcttttct

SEQ ID NO: 109892 - DNA, 201 bp, Bos taurus
atactgaagctaaaacaatattgtaaatcgactaaacttcaattaaaaaaaataaggttgcagagagagttccacatagataatcccattccacactttataaactgctctccatcttttagcagaaaataaaatggaaaagaaaaaacacactgctctgagtttgctcctgtaattcctcttttcctgactgattctgcc

SEQ ID NO: 109893 - DNA, 201 bp, Bos taurus
tgtctattgggagagatggacgagggacaaagataggctttattgttagcacatttagatacagataggtcctgcctcttttgaaagaagacccctcaaatggccacctccagctgcttcctctcctcttattcctgctgtgctggaaaggagaggaaagggtgcaggcctgggggatgtgtagctgatgtgagcagaagc

SEQ ID NO: 109894 - DNA, 201 bp, Bos taurus; identical to SEQ ID NO: 28935

SEQ ID NO: 109895 - DNA, 201 bp, Bos taurus; identical to SEQ ID NO: 28937

SEQ ID NO: 109896 - DNA, 201 bp, Bos taurus; identical to SEQ ID NO: 28938

SEQ ID NO: 109897 - DNA, 201 bp, Bos taurus; identical to SEQ ID NO: 28941

SEQ ID NO: 109898 - DNA, 201 bp, Bos taurus; identical to SEQ ID NO: 28942

SEQ ID NO: 109899 - DNA, 201 bp, Bos taurus; identical to SEQ ID NO: 28946

SEQ ID NO: 109900 - DNA, 201 bp, Bos taurus; identical to SEQ ID NO: 28948

SEQ ID NO: 109901 - DNA, 201 bp, Bos taurus; identical to SEQ ID NO: 28950

SEQ ID NO: 109902 - DNA, 201 bp, Bos taurus; identical to SEQ ID NO: 28959

SEQ ID NO: 109903 - DNA, 201 bp, Bos taurus; identical to SEQ ID NO: 28969

SEQ ID NO: 109904 - DNA, 201 bp, Bos taurus; identical to SEQ ID NO: 28973

SEQ ID NO: 109905 - DNA, 201 bp, Bos taurus; identical to SEQ ID NO: 28974

SEQ ID NO: 109906 - DNA, 201 bp, Bos taurus; identical to SEQ ID NO: 28975

SEQ ID NO: 109907 - DNA, 201 bp, Bos taurus; identical to SEQ ID NO: 28976

SEQ ID NO: 109908 - DNA, 201 bp, Bos taurus; identical to SEQ ID NO: 28977

SEQ ID NO: 109909 - DNA, 201 bp, Bos taurus; identical to SEQ ID NO: 28981

SEQ ID NO: 109910 - DNA, 201 bp, Bos taurus; identical to SEQ ID NO: 28982

SEQ ID NO: 109911 - DNA, 201 bp, Bos taurus; identical to SEQ ID NO: 28983

SEQ ID NO: 109912 - DNA, 201 bp, Bos taurus; identical to SEQ ID NO: 28984

SEQ ID NO: 109913 - DNA, 201 bp, Bos taurus; identical to SEQ ID NO: 28989

SEQ ID NO: 109914 - DNA, 201 bp, Bos taurus; identical to SEQ ID NO: 28990

SEQ ID NO: 109915 - DNA, 201 bp, Bos taurus; identical to SEQ ID NO: 28991

SEQ ID NO: 109916 - DNA, 201 bp, Bos taurus; identical to SEQ ID NO: 28992

SEQ ID NO: 109917 - DNA, 201 bp, Bos taurus; identical to SEQ ID NO: 28994

SEQ ID NO: 109918 - DNA, 201 bp, Bos taurus; identical to SEQ ID NO: 28996

SEQ ID NO: 109919 - DNA, 201 bp, Bos taurus; identical to SEQ ID NO: 28997

SEQ ID NO: 109920 - DNA, 201 bp, Bos taurus; identical to SEQ ID NO: 29000

SEQ ID NO: 109921 - DNA, 201 bp, Bos taurus; identical to SEQ ID NO: 29001

SEQ ID NO: 109922 - DNA, 201 bp, Bos taurus; identical to SEQ ID NO: 29002

SEQ ID NO: 109923 - DNA, 201 bp, Bos taurus; identical to SEQ ID NO: 29004

SEQ ID NO: 109924 - DNA, 201 bp, Bos taurus; identical to SEQ ID NO: 29005

SEQ ID NO: 109925 - DNA, 201 bp, Bos taurus; identical to SEQ ID NO: 29006

SEQ ID NO: 109926 - DNA, 201 bp, Bos taurus; identical to SEQ ID NO: 29007

SEQ ID NO: 109927 - DNA, 201 bp, Bos taurus; identical to SEQ ID NO: 29009

SEQ ID NO: 109928 - DNA, 201 bp, Bos taurus; identical to SEQ ID NO: 29010

SEQ ID NO: 109929 - DNA, 201 bp, Bos taurus; identical to SEQ ID NO: 29011

SEQ ID NO: 109930 - DNA, 201 bp, Bos taurus; identical to SEQ ID NO: 29012

SEQ ID NO: 109931 - DNA, 201 bp, Bos taurus; identical to SEQ ID NO: 29015

SEQ ID NO: 109932 - DNA, 201 bp, Bos taurus; identical to SEQ ID NO: 29018

SEQ ID NO: 109933 - DNA, 201 bp, Bos taurus; identical to SEQ ID NO: 29020

SEQ ID NO: 109934 - DNA, 201 bp, Bos taurus; identical to SEQ ID NO: 29022

SEQ ID NO: 109935 - DNA, 201 bp, Bos taurus; identical to SEQ ID NO: 29024

SEQ ID NO: 109936 - DNA, 201 bp, Bos taurus; identical to SEQ ID NO: 29027

SEQ ID NO: 109937 - DNA, 201 bp, Bos taurus; identical to SEQ ID NO: 29028

SEQ ID NO: 109938 - DNA, 201 bp, Bos taurus; identical to SEQ ID NO: 29030

SEQ ID NO: 109939 - DNA, 201 bp, Bos taurus; identical to SEQ ID NO: 29031

SEQ ID NO: 109940 - DNA, 201 bp, Bos taurus; identical to SEQ ID NO: 29032

SEQ ID NO: 109941 - DNA, 201 bp, Bos taurus; identical to SEQ ID NO: 29034

SEQ ID NO: 109942 - DNA, 201 bp, Bos taurus; identical to SEQ ID NO: 29035

SEQ ID NO: 109943 - DNA, 201 bp, Bos taurus; identical to SEQ ID NO: 29037

SEQ ID NO: 109944 - DNA, 201 bp, Bos taurus; identical to SEQ ID NO: 29038

SEQ ID NO: 109945 - DNA, 201 bp, Bos taurus; identical to SEQ ID NO: 29039

SEQ ID NO: 109946 - DNA, 201 bp, Bos taurus; identical to SEQ ID NO: 29042

SEQ ID NO: 109947 - DNA, 201 bp, Bos taurus; identical to SEQ ID NO: 29043

SEQ ID NO: 109948 - DNA, 201 bp, Bos taurus; identical to SEQ ID NO: 29044

SEQ ID NO: 109949 - DNA, 201 bp, Bos taurus; identical to SEQ ID NO: 29045

SEQ ID NO: 109950 - DNA, 201 bp, Bos taurus; identical to SEQ ID NO: 29046

SEQ ID NO: 109951 - DNA, 201 bp, Bos taurus; identical to SEQ ID NO: 29047

SEQ ID NO: 109952 - DNA, 201 bp, Bos taurus; identical to SEQ ID NO: 29048

SEQ ID NO: 109953 - DNA, 201 bp, Bos taurus; identical to SEQ ID NO: 29050

SEQ ID NO: 109954 - DNA, 201 bp, Bos taurus
ataacctactaatttccctgtgtctttctatgtgggtgaattgttttctgcctctttgttctcctaaacatgaaaggagagacacaactgctgtatgtatrctgtgtgtctcaatgacctctggtttttcctcgcatttccccccagtttaggtatttcatcgatgggagcttttcttcttcctgtttctctttccttcaa

SEQ ID NO: 109955 - DNA, 201 bp, Bos taurus
cctgagaattcccagaatccataggggcctcaaacacttccatgagaagaggatgggaagacattgtaattggaagagataattgggccaatggctggagygtgactgttttgcaaaattgagtgtttcagctggtcctagtcatcggacaatggaagggccagcatttggatattcaatcacctcctgaagctgaggatt

SEQ ID NO: 109956 - DNA, 201 bp, Bos taurus; identical to SEQ ID NO: 29053

SEQ ID NO: 109957 - DNA, 201 bp, Bos taurus
ctctgtccacaagtctgttctctgtgtctgcgtctgtgtccctgccctgccattttttaagcactacattttttatttcttaatgaaagtataggtagtascaattcttatgatggaagataatctcaaaaatataagcaagttgtacatagactgaacatgcactgttagagtagatgggctttagagtcagactttcaa

SEQ ID NO: 109958 - DNA, 201 bp, Bos taurus
tctatttctgggtggtcacagggttcctgtaaattggggccctttctcttccatcttgtttttcttgctctcttcaccacaggcagtaggatagtaacttyctgctcaagaaaccagaaatgagaggaatgctgtgaatctctctggcataggtacagtgtaatggtcacaaaatgggttttggaatcagatgtgagcttc

SEQ ID NO: 109959 - DNA, 201 bp, Bos taurus
tattgtgtttctatgtgattttacctcacaatttattttaatatctttccagcactctgatctacaaatttggaagaactgaagagctgtggacctgagaycacttctcaaatcacgttttccttttgttatattctatctgtagataattttttatttcagtatagtttacacattgccaaatggaatagattgtacatt

SEQ ID NO: 109960 - DNA, 201 bp, Bos taurus; identical to SEQ ID NO: 29054

SEQ ID NO: 109961 - DNA, 201 bp, Bos taurus; identical to SEQ ID NO: 29057

SEQ ID NO: 109962 - DNA, 201 bp, Bos taurus; identical to SEQ ID NO: 29058

SEQ ID NO: 109963 - DNA, 201 bp, Bos taurus
agtacatgatgtccggctggcctacattcagttcgccctttcctttctgattgccggtgatgacagcacgatcacgcaagtgctggagttgaaaggtaggrgggcctcgttgtcttggggcccagcctccctgtgattgttctgagcgtttaatgggttaacaaaggtcagccgcctctgtggctgctttgcacacaggaa

SEQ ID NO: 109964 - DNA, 201 bp, Bos taurus; identical to SEQ ID NO: 29064

SEQ ID NO: 109965 - DNA, 201 bp, Bos taurus; identical to SEQ ID NO: 29065

SEQ ID NO: 109966 - DNA, 201 bp, Bos taurus
aagttacttgttccccagggcccacttccctttccctcccctctccagatggattttataaacaagataaaatcagaacttaaaaagctaaacagactccrcgtggcctctttcactggctagatcagcccaggactgtttttccagacgttttcccagcctgtttgtaggagaggccagaggtaaggagtgtcaagaggg

SEQ ID NO: 109967 - DNA, 201 bp, Bos taurus; identical to SEQ ID NO: 29066

SEQ ID NO: 109968 - DNA, 201 bp, Bos taurus
caacaaggagcttagggctgaagttggaggtatcaacactgcctgggggctttcctggtggtccagtggttaaacatatgccggccagtgctggagctgcrggcttgatcgttggtctgggaagatcccacatgctgtacaggaactaagcccacgtaccttagagcatgtgcgccgcgacaaaggagctgccgcaatggg

SEQ ID NO: 109969 - DNA, 201 bp, Bos taurus
atatttgcgtctctgttttggtatccttcctgatctaagcattttgggaggatatttttcttactttcttttatggctgagttggtgtgttccaaacttgkttcttttggcttgaggccttgtgtggaatggacaccgaatttccagtgggaccgctggcagggactttcggcctctcaagtgtgcagcttttgaattgga

SEQ ID NO: 109970 - DNA, 201 bp, Bos taurus; identical to SEQ ID NO: 29073

SEQ ID NO: 109971 - DNA, 201 bp, Bos taurus
acagcaaacttgtgacagcaagggaaaaagccaaagaacataaaaaacagataagcagactgacattttatgcaatggtcccaaggacaaaatggccttcrtgaatcagtgggtcccggggcacttctgcatttcatcagagctcaggaaggaacagctgcgccaattactggccttggcacactgagataaagtcaactc

SEQ ID NO: 109972 - DNA, 201 bp, Bos taurus
tcttgtgttagttcttctggtaggttcgtgtggttgggacttttgctgtagcatattctgggaaccttctaaggaaagtcatgctgggaaaactgtgccaygtgacagagtattctcatagtctatctatcttcactgtcgcctgggtcctgggcaacgtgtacatttcacttactactgtgctcgtggtaagatgttggg

SEQ ID NO: 109973 - DNA, 201 bp, Bos taurus
caaacggacgaagtctgaaatcgtaaatgattctcgtttttatacttttgggattccatcgaaaatgcttttgtttgagttaactgtgctgtaggcagaaygctgtggtctgaggaaatgcagtctgattgagaggaaaggaaatagaagacctctagatccaatcattttattaaaaggcaagctgaactgttcctttaa

SEQ ID NO: 109974 - DNA, 201 bp, Bos taurus
aaaatgactctgtagcatgatgctttgtaaaatggtctgtagatgccatgtaaatgcttcataacccataacttcagaacaggcaaatgtcatgagcctgygatttcagtctaagaggtggcatgagagtgcctgtcccattacaaagaccatgggaagatgctgcggagtaatgagattattttgttttagttgatctct

SEQ ID NO: 109975 - DNA, 201 bp, Bos taurus; identical to SEQ ID NO: 29079

SEQ ID NO: 109976 - DNA, 201 bp, Bos taurus
tatttaactctcagcggctgctttacaacctgtgcaatccttattattttcagaactgtaatgatggttttgtgtttttattgtgatagaaaagcaatcarattgcttttccctccccaccccaaactgtcagacaaaatgacatgaggtaagaccttggagctatgatgggaaagttaagcccacaagttcactaattta

SEQ ID NO: 109977 - DNA, 201 bp, Bos taurus; identical to SEQ ID NO: 29082

SEQ ID NO: 109978 - DNA, 201 bp, Bos taurus; identical to SEQ ID NO: 29083

SEQ ID NO: 109979 - DNA, 201 bp, Bos taurus
gagcaagctacaagagttggtgatggacagggaagtctggagtgctgcagtccatggggtcccaaagagttggacacaactgaactgaactgaactgaaayatttgcaagaggaagaatgtagcattcaagcttcaggtctccctttgagatagcttcctctcttagccctttggatccatcaccttagcaggatatgatc

SEQ ID NO: 109980 - DNA, 201 bp, Bos taurus
gtcttaaccactgggccaccagggaaatcttagacctatgatttagatgtttatttctcttttacacaaaaagactgtaaagcaagacaattagagctgcygaagtttacagcgggccctgcccagtggctcagcaataaagaacccacctgcaatccaggagacgagggttctattcctgggtcaggaagcttcccttga

SEQ ID NO: 109981 - DNA, 201 bp, Bos taurus; identical to SEQ ID NO: 29086

SEQ ID NO: 109982 - DNA, 201 bp, Bos taurus
gctttaataaaacagttaaaatatttacaaattcaaaatagatgtttcataactgaaaaaaaagttcacctgagaattcattataacattgccattttttwattttttttctccaagttgttaatgtggctgagtgtccacatgcaacctgtatcgtctactgtgtcaaatatatttgattccttattttaaattagttaa

SEQ ID NO: 109983 - DNA, 201 bp, Bos taurus
ttactacctgtatgtgtctagcagacatctcacattgaacatgtccacaaaccttggttcctcgacctccagctaggatatacatcaaaatattaacaatrgttacatttaggtaatttttccttgtttctgccttcaaattcttaactataaacacatattactttagaatcagaaaaatgttcaaacagacaacaaact

SEQ ID NO: 109984 - DNA, 201 bp, Bos taurus
gataaaaactgtgaatcataccagttcctgctttgaacacagtccacaggcactgtgagcagatgggctttttggcctccaaaccattctttgctgtctaycacaggtgagtagtagataccctcttaaattagcccaactgctaagccaagaactagccagttataaacacgatagacaacttatgacagcattctgtat

SEQ ID NO: 109985 - DNA, 201 bp, Bos taurus
aattggatcttgctctggtgggcaggacagtaaaactttaatccaattgtctgctggtgggtggggctgtactccctccttgttagttgtttggcctcagrtgacccaggctatatgggaaggttaatggcgacctctaagtggacttactcaaacatgcgcctccaaggactgctgctgccagtgcccctgctcctgagg

SEQ ID NO: 109986 - DNA, 201 bp, Bos taurus
gaacaccacgtggctccaggcggtattttagcatctttgatttcctgaattaaagaatgctcgttaaaagttaagttttgagtaggacacactgccctggytcctctggccggtctctttcatccagcacagttcctctttatcactcctagaatcacagatgaaggcacagaaccctgaaccacaaaaagttctcctgcc

SEQ ID NO: 109987 - DNA, 201 bp, Bos taurus
ttctttcagaaaagatggagtcatcaaaaagatggaaatccaaggtactaatgccttattaaggatcagtaaaaataagatactacacacatattgctaartttcccaagtgtgagatataactagtaaagtgtcttttttcgttaaacctgaaattaaggttagagtaagatgcgaatataataaaggacacagacggta

SEQ ID NO: 109988 - DNA, 201 bp, Bos taurus
acttgacacggaagaagcagcaacccactatagtctgctggtgtcatattttaccagtgtcagtaaaatacagaaatcttgtcacttttaattcaatgatrtaataatcttaaatttttcttctacatacatttagaacaacagtcttataatctgtgattcagccatcagatatgtagtgccaatattaataaaccctga

SEQ ID NO: 109989 - DNA, 201 bp, Bos taurus
atgtctgacttgatggaagacagctggattctcacgtctgcttctgctttcagttgcctgccatctgttgactgaagtatattttttaaaaactaggcccrcacaggtatgtagaggttacattttctgtcaacaaaagaatatacattttgacatgtgttactagaaatgagttttcagttgtcacaagattacaattaa

SEQ ID NO: 109990 - DNA, 201 bp, Bos taurus; identical to SEQ ID NO: 29087

SEQ ID NO: 109991 - DNA, 201 bp, Bos taurus
tggccactcctggatattttaaaagcatggtctaggactggacacggtgtgaataacctcttactgagtcccagatccctggcagacagagagtgggcacrcctgggcctctctggaggggaagagggagagatacgtgacctggcagcttgagaaggttcaaatgtgctgtctcgatttcttcccttgtgttctatttca

SEQ ID NO: 109992 - DNA, 201 bp, Bos taurus
ctattcctaaccataatgaattagtcaacaagtccaccttgattgcttcacatctgtgatgcaatggaaagagtcaaccttttgttggcctttcttggtgkgtttgtttggtttgttttgcacatgtaaatccagaaaagaattgcaagagaataacagggccacactatagccaggagcaaaactgataacaatgaagaa

SEQ ID NO: 109993 - DNA, 201 bp, Bos taurus
gaatcctctagaaagaagagggtattagccaagaatacaaggccacacacagaaaataacttccttcacaaatgtcaattggcacttgagaaaagaaagtrtggactgaagtgttcaggcctctactaaaaaaggaactcagacccaagctgtaagattgaggtcaaggacaaattaaaaaaaaaaaaaaaaaaatccatt

SEQ ID NO: 109994 - DNA, 201 bp, Bos taurus; identical to SEQ ID NO: 29093

SEQ ID NO: 109995 - DNA, 201 bp, Bos taurus
tggtactgagaagcccagttcattaatgctaaatattccctgctcatcttgtaatttgacagatactagatactaatagtctagaatggcctgacatccartggaaatggcaaacagaaaaagagctttaactcagatggcagtggctatttggctaagagaatcaggaatacaataagagaaagtggtggcccatctcca

SEQ ID NO: 109996 - DNA, 201 bp, Bos taurus; identical to SEQ ID NO: 29094

SEQ ID NO: 109997 - DNA, 201 bp, Bos taurus; identical to SEQ ID NO: 29095

SEQ ID NO: 109998 - DNA, 201 bp, Bos taurus; identical to SEQ ID NO: 29096

SEQ ID NO: 109999 - DNA, 201 bp, Bos taurus; identical to SEQ ID NO: 29097

SEQ ID NO: 110000 - DNA, 201 bp, Bos taurus
tgagagatttttaaagttatgattctagatgtggaaaataagaaataaaaaattccataaggaaaatatattctgaattcctaatgaagaagcatcttackgctggcatgaattttcctttagatgatcataaaggcatcaatgtcagattctaagattttaatattttcttttcaatgttaataagtcattgatatagca

SEQ ID NO: 110001 - DNA, 201 bp, Bos taurus
atattggtgctttaggtatttcttaaatgcaaatgggtatatcctcaatatataccatttactcgcagaactagtgaacattcacaacttactgaataacrgaaagaaatgaaagagtgacgcaagctaacatttgcatgaaaccaggaagttgctaagttcacttctttcttttctcttctagtcatctcttatatggct

SEQ ID NO: 110002 - DNA, 201 bp, Bos taurus; identical to SEQ ID NO: 29101

SEQ ID NO: 110003 - DNA, 201 bp, Bos taurus; identical to SEQ ID NO: 29102

SEQ ID NO: 110004 - DNA, 201 bp, Bos taurus; identical to SEQ ID NO: 29103

SEQ ID NO: 110005 - DNA, 201 bp, Bos taurus; identical to SEQ ID NO: 29105

SEQ ID NO: 110006 - DNA, 201 bp, Bos taurus; identical to SEQ ID NO: 29107

SEQ ID NO: 110007 - DNA, 201 bp, Bos taurus
ttaagatgcagagaaagcactttataaagaaatcctatgtcagcctgccttataatatctgtgcattgtgatgatttcagttggcctatctgtttagcttkgtttaaaacatgtggtgtcaaagacataatcacttatttaaaatttggattatatcccaaaacacctgccttataatatctgtgcattgtgatgatttca

SEQ ID NO: 110008 - DNA, 201 bp, Bos taurus
taaaatcatttggtcaaaaatctaaaaaaggaggaaacgaatgtacaaacaagttaaaagttagttagaaacaggatgtgagggcacagttcttcaacttycaaggtcaatgtgcagaagctacgtttaagctctgattaaactgtatttaaacttcccactttacatttgtccaggtaaaaaagcaaagtttgatttatt

SEQ ID NO: 110009 - DNA, 201 bp, Bos taurus; identical to SEQ ID NO: 29112

SEQ ID NO: 110010 - DNA, 201 bp, Bos taurus; identical to SEQ ID NO: 29113

SEQ ID NO: 110011 - DNA, 201 bp, Bos taurus; identical to SEQ ID NO: 29114

SEQ ID NO: 110012 - DNA, 201 bp, Bos taurus; identical to SEQ ID NO: 29115

SEQ ID NO: 110013 - DNA, 201 bp, Bos taurus; identical to SEQ ID NO: 29117

SEQ ID NO: 110014 - DNA, 201 bp, Bos taurus; identical to SEQ ID NO: 29118

SEQ ID NO: 110015 - DNA, 201 bp, Bos taurus; identical to SEQ ID NO: 29119

SEQ ID NO: 110016 - DNA, 201 bp, Bos taurus; identical to SEQ ID NO: 29122

SEQ ID NO: 110017 - DNA, 201 bp, Bos taurus; identical to SEQ ID NO: 29123

SEQ ID NO: 110018 - DNA, 201 bp, Bos taurus; identical to SEQ ID NO: 29124

SEQ ID NO: 110019 - DNA, 201 bp, Bos taurus
ttactgagctagtaaattaaaatgcatcttctatttacagtgttaaattgtcagtcaaattgagttttcaataagaaagacatatgagtttttacacatayacttaatcttttccatttggaagcctctagggatctaattttagttttttgaggtatctttttagagtttagatacaaatataaaatatattttaccctg

SEQ ID NO: 110020 - DNA, 201 bp, Bos taurus
ttgctggagttattttacatgaaaattttcaatggaaatttgtgagtaaaatattattgtaactaacatttaagaatataaagtaattgatcattaaaacrtggtgaagaattttaaaaagttaatgatattatcccaaattagaacaaaaagctccaattagacaaatagacattttaagtgcaagaaaggcagacagag

SEQ ID NO: 110021 - DNA, 201 bp, Bos taurus; identical to SEQ ID NO: 29125

SEQ ID NO: 110022 - DNA, 201 bp, Bos taurus
catggggtctcaaagagtcggacacaactgagcgactgaactgaactgaactgatattactctgagatgggtgcccttgcaatagtgatgaattaccagamtggtcatggccaggcatcctgatctccacgggcaaaacaatcacaatgtgtcttcaaggacatcactgattttcaggaatgaatgtcacctgcagcctca

SEQ ID NO: 110023 - DNA, 201 bp, Bos taurus
ctgcctgccaatgcaggagacaggggttcaatccctgagtggggaagatcccctggaaaaggaaatggcaacccactccagtactcttgcctgggaaattycatggatagaagagactggtgtcaatccctgggtcgcaaagggatctgtccatccctacagtctgcaggattgcaaagagtcggtctttgcggcggactg

SEQ ID NO: 110024 - DNA, 201 bp, Bos taurus
gtagggccatgcatggagataggtagcttatgcccaaaaagctccaaatgccccaaagtattgagggaagcatatataaagatgaggggagggaagagggkagggtcatagggtctgtgatctgttgtgctcagttctctgattggttgatgttgaggtaaatgggtggtgtcacattattaatccttaagctccattagg

SEQ ID NO: 110025 - DNA, 201 bp, Bos taurus; identical to SEQ ID NO: 29126

SEQ ID NO: 110026 - DNA, 201 bp, Bos taurus; identical to SEQ ID NO: 29128

SEQ ID NO: 110027 - DNA, 201 bp, Bos taurus; identical to SEQ ID NO: 29129

SEQ ID NO: 110028 - DNA, 201 bp, Bos taurus; identical to SEQ ID NO: 29130

SEQ ID NO: 110029 - DNA, 201 bp, Bos taurus; identical to SEQ ID NO: 29131

SEQ ID NO: 110030 - DNA, 201 bp, Bos taurus; identical to SEQ ID NO: 29132

SEQ ID NO: 110031 - DNA, 201 bp, Bos taurus
aataacagtttggcacaaaatcttaaagattccaactcatttctttagaaaatcagcacagactggaaaggtgactttaaaaactttaaaaaatcttttgygttaaatttcattatgttaaatttttttagttcctactttacataatgattaacagaaatagtctcagcaaaattaatcagaagacttccttcctataaa

SEQ ID NO: 110032 - DNA, 201 bp, Bos taurus
cagttttgcttaggcaattgcaagtaatacagattcaaagaagcattggaataaaaactgtaaagtgtaatttggagtaatgtcaaaatatattttagctrttgagaaactagaagattatttaagcaaaaacaagcaaataaaccaaagaacccctttagatccatttcatcacaagtggtaggcaaagaagtttgttaa

SEQ ID NO: 110033 - DNA, 201 bp, Bos taurus
tacaaaaagaatctggacatacacacacacaatagtggaaggactatttacactggaacacagaattttgcggttgttgtttacaagcaaaatattgtacrggaatcctttaagctaggcttcaacaatatgtgaactgagaacttccagatatacaagctgaatttagaaaaagcaggggaattagagatcaaattgcca

SEQ ID NO: 110034 - DNA, 201 bp, Bos taurus
tttcatgatttgtttatctaaaagactgaaacagtgcaaagttctcttcttacatacacaaagcttataataatgacctgcaggactggccatcctaaatyaccacagagctccactctactttagtggcttgattaaaaagatgaatggttgcaggttcaattcaggaaagtcaaggaaaggaacatataatgacctctt

SEQ ID NO: 110035 - DNA, 201 bp, Bos taurus
aaggaatagctgggaaagaagaaatatcacagaataatatttttatttttaggatcaaaagacattgtgattcagtggctcttaaatatctttaggtttcyggcttgatttcatgatctagtagacagctcagctggtaaagaatccgcctgcaatgcaggagaccccggtttgattcccaggtcaggaaggtccgctgga

SEQ ID NO: 110036 - DNA, 201 bp, Bos taurus
atgtgaattgagattattttataaagcaataaatataggtgattataatatagaaaactttatgtatcaggatataagggatattcttaaaaataattatmtgagagaaagacatgtatgaatatatgattgtattgtatgaatgtatggatttttactatatcaacaatataatacaaacatgccatgtatatatctatt

SEQ ID NO: 110037 - DNA, 201 bp, Bos taurus; identical to SEQ ID NO: 29135

SEQ ID NO: 110038 - DNA, 201 bp, Bos taurus; identical to SEQ ID NO: 29136

SEQ ID NO: 110039 - DNA, 201 bp, Bos taurus; identical to SEQ ID NO: 29138

SEQ ID NO: 110040 - DNA, 201 bp, Bos taurus; identical to SEQ ID NO: 29139

SEQ ID NO: 110041 - DNA, 201 bp, Bos taurus; identical to SEQ ID NO: 29140

SEQ ID NO: 110042 - DNA, 201 bp, Bos taurus
caagtctcaggcagagggttttgatggtaactcaagaatgtcacagtcattcacaggtaggcaggctcaggttatctctctgtgaactaaacaaaggcacrttagcttaagggtcaagaggagggtgagagagggcaagggtcagagaggtttaagggtcagaggagggcaaggttccctgaccattatgtttgtttataa

SEQ ID NO: 110043 - DNA, 201 bp, Bos taurus; identical to SEQ ID NO: 29142

SEQ ID NO: 110044 - DNA, 201 bp, Bos taurus
tacaccacacttagactgcagacttaattttaatatgccatgtcccacctctatacaatcatataatgttaatacatatcttaccaaaattcagttgtagrgcttgatttttcaaaatgaaaaaggagagtaatgtgtgcctatctactgaggttttgaataggaaacactatttttgggaggaaaggggtgacccatgta

SEQ ID NO: 110045 - DNA, 201 bp, Bos taurus; identical to SEQ ID NO: 29143

SEQ ID NO: 110046 - DNA, 201 bp, Bos taurus; identical to SEQ ID NO: 29146

SEQ ID NO: 110047 - DNA, 201 bp, Bos taurus; identical to SEQ ID NO: 29147

SEQ ID NO: 110048 - DNA, 201 bp, Bos taurus
tctgtctttagtccatttctatacagtggcagagagttttatttaaattctggaaattgatttacttatttttcttcaagcaagttctgcttattgttcaygtttgttttattcattagttgaacaaaaaaactggatatttgttttcataatcctgtccaaattgtaggatcttctatgtaaataaacataatgttatac

SEQ ID NO: 110049 - DNA, 201 bp, Bos taurus; identical to SEQ ID NO: 29150

SEQ ID NO: 110050 - DNA, 201 bp, Bos taurus; identical to SEQ ID NO: 29151

SEQ ID NO: 110051 - DNA, 201 bp, Bos taurus
tatacaaaaaaggaaacacttgactatgtggatagagggagacctaactgctgaaagtttgatagatacaagagtatactgagtaacattctggcagtacrtacattatggaaaataaacaaataaactttctgaacaagtaaaagtattactcaagacatggaatgaagttaacttcagaagccatgcccacagagcaga

SEQ ID NO: 110052 - DNA, 201 bp, Bos taurus
ttacttgacacttttcactcatttggtccaattatactcagaggtccctgtcacatcagtaaaattttaacagtctgggccatgtctgaatatttcctttraagtaaaggacaactattgtatttcacacattccagcaccaggaaggatacggtaggcagattattgggcctaccagagacttctgtatcttaatccttg

SEQ ID NO: 110053 - DNA, 201 bp, Bos taurus; identical to SEQ ID NO: 29152

SEQ ID NO: 110054 - DNA, 201 bp, Bos taurus
tgaagctttagcttcagcatgagtccttccaatgaatattcagggttgattccctttaggattgactggtaattttaccttaactaccttttaagggctcyatgtccaagggcaaacacatctgaagtactgggggattaggattttaacaaatgaattctgaggctgtagtactgaatctgtaatatgaagtacaatggc

SEQ ID NO: 110055 - DNA, 201 bp, Bos taurus; identical to SEQ ID NO: 29155

SEQ ID NO: 110056 - DNA, 201 bp, Bos taurus; identical to SEQ ID NO: 29156

SEQ ID NO: 110057 - DNA, 201 bp, Bos taurus
aatatttatatcccaggcctatatttaactgggtttcacctgacagatgtaataacttccagcgttttatatgaaaaggctggaatttatatatacacatrataatcaaacccctgaggctcaggccagaggatgccaggagaatactgacatttaaggctgctgtggattttttttcccagcagaaggagcatttaagtg

SEQ ID NO: 110058 - DNA, 201 bp, Bos taurus
ccaattaatctcacctttataaatgcctgtgttttattgcaagtaatttgagttttctgaatcagaagtagaacacagtatgcactcatttctctcctccrccttcagttatctattttgaaaaaagtaaagggctttggaacacagtttcttagggagcttttcttgatcccttagtttcaaggcttaaaaacaacatca

SEQ ID NO: 110059 - DNA, 201 bp, Bos taurus; identical to SEQ ID NO: 29161

SEQ ID NO: 110060 - DNA, 201 bp, Bos taurus
aatgtctattgcaacgctataattagcatcacaagaaacttcaataagtgtagctatgctcaattttcctgtaaggccccattcattcatcctaggctttygagaatcttggcttttttttttttttttttcagaaaccttccccaaaagtaagggagagtgaatgtggtatgaattgctcaacaacaggacagtaaaagt

SEQ ID NO: 110061 - DNA, 201 bp, Bos taurus; identical to SEQ ID NO: 29163

SEQ ID NO: 110062 - DNA, 201 bp, Bos taurus; identical to SEQ ID NO: 29167

SEQ ID NO: 110063 - DNA, 201 bp, Bos taurus; identical to SEQ ID NO: 29168

SEQ ID NO: 110064 - DNA, 201 bp, Bos taurus
ctttccccttcttcccatttgcttccaaaaatggatctgctattaaactcattttgtagatgctgtagatgttgacatgagcttctttcacatttttatgrtgctgacaccagcaaaagttaagaggaagttgaaactgttggggttttatgtgactttggtgacctatatatttaaggctttcttttctgtctgtgaatt

SEQ ID NO: 110065 - DNA, 201 bp, Bos taurus
aattattagattttgatcatatttaatttcctcatttgaaaagtgagtaatttccaagttgatttctctaatgttctttataaatccaaatgagaattgartatatttgggcatggtgctagtttgcattaaaatactactccgagtgtctaggattggtcctgctctagtttaatatttccatgatttgatggcttaaat

SEQ ID NO: 110066 - DNA, 201 bp, Bos taurus
ggactgtccccctgtcactgctaccctggacatggctttcttgggacatatgaagccataggtaaaagccaatggctcaagtacaatttggtcatgttttyaagactataaatctcatactggtcaaatatggtcaagccataactatcagaaacaagacagaaaacttggctatcaggcttccaggagaagagaggagag

SEQ ID NO: 110067 - DNA, 201 bp, Bos taurus; identical to SEQ ID NO: 29169

SEQ ID NO: 110068 - DNA, 201 bp, Bos taurus
ttggccaacccgtggacacccctaccttcaccccatatgaggaacaagctcaggtcccctcagggaaggagctggcaagggaatctgttatttgttctcgmtccccactgctgcagcagggccccagtaaattgcctaaatttcttgtctggactctgattaattcccattgattaaggaggccaagaaacttagtcagta

SEQ ID NO: 110069 - DNA, 201 bp, Bos taurus; identical to SEQ ID NO: 29171

SEQ ID NO: 110070 - DNA, 201 bp, Bos taurus
aatgggcctgcagcttcttatagtgccaaaaagtaagtaccagaaataaaaataaaaaataaacaatggtgaagatacattaaagggatacaggagccaaytgaaagaggtctcaagggccaaatttgaagcaatttaaacaacaaaatacataaagtagtattggactacaacccaaagtatcaatactaaataaatatc

SEQ ID NO: 110071 - DNA, 201 bp, Bos taurus
gcttgagcaattgggtgggtgagggtatttaacaagggtgggtgctgaaataaggctggaagtatttctactggagaaggttgattccaggccagaaagtmagcccctcataaaattctactagaggaatataaaagtcctcaccaaacataaatctcatttccttccccctgcaaattgctggccactcctcctaggctc

SEQ ID NO: 110072 - DNA, 201 bp, Bos taurus
gagatgagatggttggagagcataactgactcaatggatatgaatatgagcaaactccaggaaacagtgaagacaaagatgcttagcgtgcttaccgtccrtggggggcacaaagagtcacaaatgacttagtgacagagcaatattacagcaaaaaggatacaaatcaggaccttcacagagaagaaacacaagcagaag

SEQ ID NO: 110073 - DNA, 201 bp, Bos taurus; identical to SEQ ID NO: 29177

SEQ ID NO: 110074 - DNA, 201 bp, Bos taurus
tgcaatcttggaatcttgctcatttctttaaaaaaaaaaacctattctgatcatattaaagatcagaagtgggcaaactatggctcacgggccaaatctarctggctgtctacatttttgtaaatcaagatttactggaacacaactgtactcattaaattatgtactaccagtggctgcttttacactgtaacgctagag

SEQ ID NO: 110075 - DNA, 201 bp, Bos taurus; identical to SEQ ID NO: 29178

SEQ ID NO: 110076 - DNA, 201 bp, Bos taurus
accctgtctatagtgcttcgtttcagcagccagaactaacataatgatgtcttcatagcaggagtaacacaaaaattgtgtttcaaaatggatatgagtgmtccctagataaatgaacaacacagcacaagcaaaggcagaagcactgtgtgcctttggggaaccccaagagtgctgcctgacagcgctggggctgggcag

SEQ ID NO: 110077 - DNA, 201 bp, Bos taurus
atagctgagaagcagagagggggtaagtggatggaaaactactgagaggaaacatcaggaagagagattctagctagatggacctgacaggatctttcctraagacaggccatggtagggacttttctggtggtccagtggttgggaatccactttccagtgcagaggagaagggttcaatccctggctggggaattagaa

SEQ ID NO: 110078 - DNA, 201 bp, Bos taurus
ccagaaagttgtctgagatggaattgaagagctaaggcactagtggggattttttaaaaacacctgtatatgctactttgccaagttagagctccattgtrtcaataaatgtgggaatttaacagtaagtcatatacacacagggcttccctggtggctcagagggtaaagaatccacctgcaatatagaagaactgggtt

SEQ ID NO: 110079 - DNA, 201 bp, Bos taurus; identical to SEQ ID NO: 29179

SEQ ID NO: 110080 - DNA, 201 bp, Bos taurus; identical to SEQ ID NO: 29180

SEQ ID NO: 110081 - DNA, 201 bp, Bos taurus
cacacgaaaaatagagatataagtatgggtagggaaaaatattacttaacagatgatgtatcaactacacagaaaacccccaaagaatcaataaactatamaaccaagtgacaaattaagtaagaggtcagacgaaggaacagctttcaaaattcagtaacatttttctaaactagaaataaccagctgagaaaatataaa

SEQ ID NO: 110082 - DNA, 201 bp, Bos taurus; identical to SEQ ID NO: 29185

SEQ ID NO: 110083 - DNA, 201 bp, Bos taurus; identical to SEQ ID NO: 29186

SEQ ID NO: 110084 - DNA, 201 bp, Bos taurus
tccatttctgattgtaaatggccagaaaagagaacatggtcctgtataaagtatgcttgatgtcaactggaataaaatctcaagtgctttgtggaaagttracataaaaatcttaaaattcctcaagatggcactgtaaatttctcattacttaaattaaaaagtggagtttctattgagcattgttgttttttttttttt

SEQ ID NO: 110085 - DNA, 201 bp, Bos taurus
attcccacatgaactgactttcccctaggactaccttgaagccttcaacataattaatacttttggtagccacataatccatcttcaccctctcccacccyacaaatacaatggattcttgtttctctacactttccattcaagagctgacattattttgaaactgaattcttatatcctatatcccattaaccacatcca

SEQ ID NO: 110086 - DNA, 201 bp, Bos taurus
cagcttatggacattcttctggttggttggtggtgagataattgggagtgagcatcatccatcttctggttccaaccactttagggtccatgttcttgccrtcaacagctttcatcatggggggtctgcattttgtagaaacaacttaggaatgtgtatcaggcctttatcactatcttttaagaactgtctttagtgttc

SEQ ID NO: 110087 - DNA, 201 bp, Bos taurus
tgcaatgcaatgcatgagggatcaagtaattaaaatatagcttggatttctccagcattattctgcatgcaaacttccccttctcttgtctgcacacacamaaaaagtaagaaacacaattcaatagccaggagactaaaagaataacataaatctttattgcagcattccttaaaagaacaaataagtgggggttatata

SEQ ID NO: 110088 - DNA, 201 bp, Bos taurus; identical to SEQ ID NO: 29188

SEQ ID NO: 110089 - DNA, 201 bp, Bos taurus
aaaaaaaaagctacatagagaaaaatcacagaatagtcaaataacacttctttactatatcctggcaaccatcttacttaaagctcttttaaatacagtgrttttaagaatatatagatgaaaattacagaaacaattgaaagcttttcatctcatatattttaattttattacttgaaatagttggaaactagttagact

SEQ ID NO: 110090 - DNA, 201 bp, Bos taurus; identical to SEQ ID NO: 29189

SEQ ID NO: 110091 - DNA, 201 bp, Bos taurus; identical to SEQ ID NO: 29192

SEQ ID NO: 110092 - DNA, 201 bp, Bos taurus; identical to SEQ ID NO: 29193

SEQ ID NO: 110093 - DNA, 201 bp, Bos taurus; identical to SEQ ID NO: 29194

SEQ ID NO: 110094 - DNA, 201 bp, Bos taurus; identical to SEQ ID NO: 29195

SEQ ID NO: 110095 - DNA, 201 bp, Bos taurus; identical to SEQ ID NO: 29196

SEQ ID NO: 110096 - DNA, 201 bp, Bos taurus
tgatcctgcttttctgctctcaacaaaaagtcatctttacacaacagcagccaagcaagtccgggaagatggaaacactggatggcagcttcacatacacktagtgtgtgtgctctgtgagagcctgggctttgaaatgagactcctagattggaatccttgcattgtgtgttctcgtgcttttcattagtgaggatagct

SEQ ID NO: 110097 - DNA, 201 bp, Bos taurus
aggaagaattgaggataagccaactttacatttattacaatattttatatttaaaaatcttattaatcttcacaaaggtctaaggccttgtagaaacaaaygttacagcatcgtaaaactttcctagaacttttgtttttaccttttagaagttccaagaaatttttcaaagctaacttgaatatatgatatcctggcctg

SEQ ID NO: 110098 - DNA, 201 bp, Bos taurus
aattaagtgacataaaagtatagttctactaattaatgaagctcattctggagaacagattttatatcagtgggctcaggacctcctaatagtgattctcrtttcagagaattcatctgttatgtcaaaattatttctggagtcctgtttgggggagggggtgggggacaggcttcttctacgatatgacaaaggtcagaa

SEQ ID NO: 110099 - DNA, 201 bp, Bos taurus; identical to SEQ ID NO: 29198

SEQ ID NO: 110100 - DNA, 201 bp, Bos taurus
gaatactggagtgtgctgccatttcctcctccaggatatcttccccacccagggatcaaatccatgtctcttgtatctttgacactggaaggcaaattctytaccactgcaccacccaggaagccctttgagtaatacagaatttctaaactcttttccccaggacactccttgactacagtttctatactttgcctactc

SEQ ID NO: 110101 - DNA, 201 bp, Bos taurus; identical to SEQ ID NO: 29199

SEQ ID NO: 110102 - DNA, 201 bp, Bos taurus
agactggaataaatggaaaaaagttggcattccaccttactggtcatcataaaaaatgagagaaaaagacatggctgttaacagaatgatttgatctgtcrtattgatgggcagagataaaagtgctgagaaccatacctcaagttggcacagctcactgaaagcaaatttgctgtgaatgatgataatttgtactgaaag

SEQ ID NO: 110103 - DNA, 201 bp, Bos taurus
catagaatcttaaccactggaccaccagagaatttccattagacctttagtaatgtagtagcaaaatgtgagggaagggaaagtgttctagagtcctatgrttaggcctctgtccttcagtcagcttgtgattcttcttttcccctctctttggtggaacaggatggctcaagtgggctgaagttgtgtatttccctttcc

SEQ ID NO: 110104 - DNA, 201 bp, Bos taurus
ctgacccagggattgaactcgtatctcttatgtctcctgcattcaaaagccagttctttaccactagcgctacctgagaaacccaaaaaagacggtgtgtrtgtgtgtgtgtgtgtgtgtgtatgtatgtatgtgtattttttttcagtcagttatgttcaactttttgcaaccctaaggactgtagtctgccaagctgtc

SEQ ID NO: 110105 - DNA, 201 bp, Bos taurus; identical to SEQ ID NO: 29201

SEQ ID NO: 110106 - DNA, 201 bp, Bos taurus; identical to SEQ ID NO: 29203

SEQ ID NO: 110107 - DNA, 201 bp, Bos taurus; identical to SEQ ID NO: 29204

SEQ ID NO: 110108 - DNA, 201 bp, Bos taurus
caagtgtatgtacatatgtgtgataacatgttataacaaacagatattacttttaaaaagataaaaatggagacctcaggaaaaaaaatgtattcactaakgcaccctgagtgactagatcagtagggaataaatatttgttgagtgaacgagtagtttataatcttacagaaaaacacaatacatccagggacatctctg

SEQ ID NO: 110109 - DNA, 201 bp, Bos taurus
gaacaccataggcccgtttaacatcaggaagcccatttgacagaactgcattatgtcatcacatctgtgctatatgttgtctgtgataggtaacagaattyaaaagaaagaaactgaatgtcatcattttgtttggaagggtaacttgcaagtgcacatagggaacatgataaaaaatttaaaagcttgtttattaaaagg

SEQ ID NO: 110110 - DNA, 201 bp, Bos taurus
tagcctgtcatatgcaaacaattcttaactcctgtggttaattaaaggtatattttctttaatgtacacaagtaaatataaacaaatacctttatacataktgctttctttgcttggtaaactcctactctccttcaaaacctttcctggacactccagagagtgttaggcatttgtcctccgtttttcagaataaatatc

SEQ ID NO: 110111 - DNA, 201 bp, Bos taurus
tatgtcatctactaacaaacctaaaattcaataaagattagtccctttgattattctttcaagatatcttacaatcataataaagctgtaacttatctagyattcaaacaactgaaaactttttagcataaaaagtcattttctctacacatttgacccatgaaactgataatcataaaaatgatgttatgatattaatac

SEQ ID NO: 110112 - DNA, 201 bp, Bos taurus
aagatcctgatcagagtgcacaaacaagttacatgtgcagttactccaaattcccaggtaaacaccatggttttatcagcatccctccctctgctcacacrcattgatctctggaggcttctggataaatggcataaaatgaagaaaaatgcatacattagtttgtggatgggtaagttcaatatgaggaagcagtgcagc

SEQ ID NO: 110113 - DNA, 201 bp, Bos taurus
tataaaagggattttttgtaacataaatctataaatgtgacaggattttttatatagattaatagttaataggtaagtacacatattcataaactcctaamagttcttaagggtatatgcatgcatgctcagtcatgttggacactttgcgaccccatggactgtagccctccaggcttttctgtccatggaattttccag

SEQ ID NO: 110114 - DNA, 201 bp, Bos taurus; identical to SEQ ID NO: 29208

SEQ ID NO: 110115 - DNA, 201 bp, Bos taurus; identical to SEQ ID NO: 29209

SEQ ID NO: 110116 - DNA, 201 bp, Bos taurus; identical to SEQ ID NO: 29210

SEQ ID NO: 110117 - DNA, 201 bp, Bos taurus; identical to SEQ ID NO: 29211

SEQ ID NO: 110118 - DNA, 201 bp, Bos taurus; identical to SEQ ID NO: 29213

SEQ ID NO: 110119 - DNA, 201 bp, Bos taurus
cccaccaaaaaaaagataccccatgtccaagggcaaaggagaagccacaacaagacaggagcaggcatgcaataacttttaaaatcaaaccccataaccaycagagatgtttggagcatacaaacaaaaccttgtgtgcatcaggacccagagaaaggagcattgacctccacaagagactgagccagaccagcctttgag

SEQ ID NO: 110120 - DNA, 201 bp, Bos taurus
aaggatccagcctggaaattccaaagtcatctttttttgactctcctaaaaactctacttatgcttaaaaaatataataactttctgtgaaagaaaagtayatgatttcctcatccaaataccaccctttttgaactaggtcttatttatttagccctacatttttttgtattttcagtaaaccagagctaatattgatgt

SEQ ID NO: 110121 - DNA, 201 bp, Bos taurus
caaaatgtgacagtgtgctaaaagagaaagtttgtaaattcacattggtaaaaaacaaacttatgctgatatttcatacctcagcaatgaaagtgagctaycttaattttacataaaatttaaccagttaatggatgaaaacacctctctgtaatataaaatgcttcattttacagtttttttccctcaaaaaactctggg

SEQ ID NO: 110122 - DNA, 201 bp, Bos taurus
gaggctgttcctggcaggcttcaggggccaccagactcgcacatggactttgccttgccttctccaaagggagttgcagtcaaggattcagggtccccagytggccaggctattatacatatctgatatatctatagtatgtaatatgtatacacatgtatacgtagtaatacatatgtaatatgtataatatacatattc

SEQ ID NO: 110123 - DNA, 201 bp, Bos taurus
tcttataaaaagaaggaagatcattgttcaccagatcatcacaaagtaaaccagtcacaagtttctggacgtgcttcaatcttcaatacaaactgaaagcygaggatcatcatgaaatcctgtagtactgaatagtaaatcaaaagctagaataaaccctggcaaggaagacagcaataagaatggagacagagaaatgga

SEQ ID NO: 110124 - DNA, 201 bp, Bos taurus; identical to SEQ ID NO: 29232

SEQ ID NO: 110125 - DNA, 201 bp, Bos taurus
attatttttaccttgcatcttaagagttcagtgccaccatgtgactacttttattctaaaaccctgccattccattgtcataatgagtccagcttcatgaytgcatttccaattccatcaaccttgaactacaagagacagctacctttgaattccttatcacttaggtaaaggagatcctctggaccaatatagacttct

SEQ ID NO: 110126 - DNA, 201 bp, Bos taurus
cttcttgggaaaatttaggagttatttggagtggacattccagtcatacccagataagggagctgagtcatagcccaactgacttgtgtgtgtagctcctrtcctgtttggccagatgggatggtaggaatgcctggagattacatagcacagcaagctccaacagagagatgagaaggaagaactaaccatccacaaaat

SEQ ID NO: 110127 - DNA, 201 bp, Bos taurus; identical to SEQ ID NO: 29235

SEQ ID NO: 110128 - DNA, 201 bp, Bos taurus; identical to SEQ ID NO: 29236

SEQ ID NO: 110129 - DNA, 201 bp, Bos taurus; identical to SEQ ID NO: 29237

SEQ ID NO: 110130 - DNA, 201 bp, Bos taurus
agcttcttttagataaaattcttaataaacatgttattcagtactttggaaggatgaagacaaaacaaacataattttacaaaattgtgtcctaaatactrtgttaggaaccaactggatgcttttttttttttttttttcaatgaagtttcattttaaaagtaatatatcataccagaggcatgtgagttcagctgacta

SEQ ID NO: 110131 - DNA, 201 bp, Bos taurus
taataactcaccacaggtgagaatttagtacatttcaacttctatggtttgatttatagaaacaatatttcacttattttacactcaaatatattttatcrgtcgatatgctattaaagctacctctctgagaatgaacaggttggaaaaatagcaagagtgtttcccagctgggaactaccctgtgtcagatggccaata

SEQ ID NO: 110132 - DNA, 201 bp, Bos taurus
gccctttttattaatgccgtttaccaatctagcgtggtctgcctttttcctttgttctttccctgccctcctgcacaggggccagtttagattttacccakggaagctcctaaggagggttcaaagctatacatatatgaatatgtatatgtacatgtgcatgtttacaaacacaaatcttgatagatcatggccttctcc

SEQ ID NO: 110133 - DNA, 201 bp, Bos taurus
acaggtgaatgggtgctgtgaaagcacacaactgtctgtgagttaggatgaaactaggggccttaggttccctgtactatggaggagttaaaattatttcmtacagtatttgataaatgaaacgaaataaatgacaaatgaaattcctaaattatatcctaatgatttgtgacctattgaagactagggcacggctgagaa

SEQ ID NO: 110134 - DNA, 201 bp, Bos taurus; identical to SEQ ID NO: 29240

SEQ ID NO: 110135 - DNA, 201 bp, Bos taurus; identical to SEQ ID NO: 29241

SEQ ID NO: 110136 - DNA, 201 bp, Bos taurus; identical to SEQ ID NO: 29242

SEQ ID NO: 110137 - DNA, 201 bp, Bos taurus; identical to SEQ ID NO: 29244

SEQ ID NO: 110138 - DNA, 201 bp, Bos taurus
ggtatgtaatgaatgtttcattttaattacttactgttttgtttccatatctgcccagaagtgagagctacaacctcatttgggagctcccatgtatcccragttttcctgccataatatatgaattcttgattctaaaagctgaattactgagatgaaatggctttgagttgaatcatttcactctggaaagtagttgtg

SEQ ID NO: 110139 - DNA, 201 bp, Bos taurus; identical to SEQ ID NO: 68846

SEQ ID NO: 110140 - DNA, 201 bp, Bos taurus; identical to SEQ ID NO: 29250

SEQ ID NO: 110141 - DNA, 201 bp, Bos taurus; identical to SEQ ID NO: 68850

SEQ ID NO: 110142 - DNA, 201 bp, Bos taurus
tttttctttaaaaatacattttttttaaatttaccaaatcaattattatcaaattttctacaatcagaaaagtatgaccaatatcaaaaaatttagagacragttactgttttggtcccagcctatcaatagtgatacttttggctatgactgcttgagacgcttggctcagctcctgttgcttttaggagcacctgcagg

SEQ ID NO: 110143 - DNA, 201 bp, Bos taurus; identical to SEQ ID NO: 29253

SEQ ID NO: 110144 - DNA, 201 bp, Bos taurus
aatgaccttggtaacatttgtcttacttgaaatgtcagaagtatttggcatagctcattactcttcttctagtaatgttattatctcttttgtcatgacartacatatttaaggtgtttcctttactatattgtctgctgcctcttagtctcttttgctccttaaccttctctgttctctaaaatattggtgagtcactgg

SEQ ID NO: 110145 - DNA, 201 bp, Bos taurus
agcaatagattgaggttacagtctatgaagaggcctattagctcatcttcaaagctgtggcctgagggtcagactgctaattaaacatgtatctaatggckagttgtgatcccctccaaacttggagggtgggtgctatcttcacatgcactgtctctctgcacactgcagagacccaatacctcctggagggaagactgt

SEQ ID NO: 110146 - DNA, 201 bp, Bos taurus; identical to SEQ ID NO: 29254

SEQ ID NO: 110147 - DNA, 201 bp, Bos taurus; identical to SEQ ID NO: 68855

SEQ ID NO: 110148 - DNA, 201 bp, Bos taurus; identical to SEQ ID NO: 29255

SEQ ID NO: 110149 - DNA, 201 bp, Bos taurus; identical to SEQ ID NO: 29259

SEQ ID NO: 110150 - DNA, 201 bp, Bos taurus
ttggatccatttaatttggtctatccctcatgagagatggcagtgtgagtaggtggtagtttttaggttatggtgataattgttcttcctgatgaaatggygaaagactatagataattacatgaaatttgaacacaaggaattaaatggctagcaaatgttaattgagtctggggtctgagggcaaggtagtgtagtaga

SEQ ID NO: 110151 - DNA, 201 bp, Bos taurus
tcaataagtttggccaaactgccagtggtgtgtgggtttggatttttctctctccaggaaattataacaattcagaccagactagaagacacagggtcatrtctcatcatttatggcccatggcctgggaatggggactaggtggtcaagctcaactgtgtaatagtggaaaggagaaaggagatagtgtgaatggagaaa

SEQ ID NO: 110152 - DNA, 201 bp, Bos taurus; identical to SEQ ID NO: 29260

SEQ ID NO: 110153 - DNA, 201 bp, Bos taurus; identical to SEQ ID NO: 68864

SEQ ID NO: 110154 - DNA, 201 bp, Bos taurus; identical to SEQ ID NO: 68866

SEQ ID NO: 110155 - DNA, 201 bp, Bos taurus; identical to SEQ ID NO: 29263

SEQ ID NO: 110156 - DNA, 201 bp, Bos taurus; identical to SEQ ID NO: 29264

SEQ ID NO: 110157 - DNA, 201 bp, Bos taurus; identical to SEQ ID NO: 68867

SEQ ID NO: 110158 - DNA, 201 bp, Bos taurus; identical to SEQ ID NO: 68868

SEQ ID NO: 110159 - DNA, 201 bp, Bos taurus; identical to SEQ ID NO: 29265

SEQ ID NO: 110160 - DNA, 201 bp, Bos taurus; identical to SEQ ID NO: 29266

SEQ ID NO: 110161 - DNA, 201 bp, Bos taurus; identical to SEQ ID NO: 29267

SEQ ID NO: 110162 - DNA, 201 bp, Bos taurus; identical to SEQ ID NO: 29268

SEQ ID NO: 110163 - DNA, 201 bp, Bos taurus; identical to SEQ ID NO: 29269

SEQ ID NO: 110164 - DNA, 201 bp, Bos taurus; identical to SEQ ID NO: 29270

SEQ ID NO: 110165 - DNA, 201 bp, Bos taurus; identical to SEQ ID NO: 68870

SEQ ID NO: 110166 - DNA, 201 bp, Bos taurus; identical to SEQ ID NO: 29272

SEQ ID NO: 110167 - DNA, 201 bp, Bos taurus; identical to SEQ ID NO: 29273

SEQ ID NO: 110168 - DNA, 201 bp, Bos taurus; identical to SEQ ID NO: 29274

SEQ ID NO: 110169 - DNA, 201 bp, Bos taurus; identical to SEQ ID NO: 29275

SEQ ID NO: 110170 - DNA, 201 bp, Bos taurus; identical to SEQ ID NO: 29276

SEQ ID NO: 110171 - DNA, 201 bp, Bos taurus; identical to SEQ ID NO: 29277

SEQ ID NO: 110172 - DNA, 201 bp, Bos taurus; identical to SEQ ID NO: 29278

SEQ ID NO: 110173 - DNA, 201 bp, Bos taurus; identical to SEQ ID NO: 29280

SEQ ID NO: 110174 - DNA, 201 bp, Bos taurus; identical to SEQ ID NO: 29281

SEQ ID NO: 110175 - DNA, 201 bp, Bos taurus; identical to SEQ ID NO: 29282

SEQ ID NO: 110176 - DNA, 201 bp, Bos taurus; identical to SEQ ID NO: 29283

SEQ ID NO: 110177 - DNA, 201 bp, Bos taurus; identical to SEQ ID NO: 29284

SEQ ID NO: 110178 - DNA, 201 bp, Bos taurus; identical to SEQ ID NO: 29285

SEQ ID NO: 110179 - DNA, 201 bp, Bos taurus; identical to SEQ ID NO: 29286

SEQ ID NO: 110180 - DNA, 201 bp, Bos taurus; identical to SEQ ID NO: 29287

SEQ ID NO: 110181 - DNA, 201 bp, Bos taurus; identical to SEQ ID NO: 29288

SEQ ID NO: 110182 - DNA, 201 bp, Bos taurus; identical to SEQ ID NO: 29289

SEQ ID NO: 110183 - DNA, 201 bp, Bos taurus; identical to SEQ ID NO: 29290

SEQ ID NO: 110184 - DNA, 201 bp, Bos taurus; identical to SEQ ID NO: 29291

SEQ ID NO: 110185 - DNA, 201 bp, Bos taurus; identical to SEQ ID NO: 29292

SEQ ID NO: 110186 - DNA, 201 bp, Bos taurus; identical to SEQ ID NO: 29293

SEQ ID NO: 110187 - DNA, 201 bp, Bos taurus; identical to SEQ ID NO: 29294

SEQ ID NO: 110188 - DNA, 201 bp, Bos taurus; identical to SEQ ID NO: 29295

SEQ ID NO: 110189 - DNA, 201 bp, Bos taurus; identical to SEQ ID NO: 29296

SEQ ID NO: 110190 - DNA, 201 bp, Bos taurus; identical to SEQ ID NO: 29297

SEQ ID NO: 110191 - DNA, 201 bp, Bos taurus; identical to SEQ ID NO: 29298

SEQ ID NO: 110192 - DNA, 201 bp, Bos taurus; identical to SEQ ID NO: 29299

SEQ ID NO: 110193 - DNA, 201 bp, Bos taurus; identical to SEQ ID NO: 29300

SEQ ID NO: 110194 - DNA, 201 bp, Bos taurus; identical to SEQ ID NO: 29301

SEQ ID NO: 110195 - DNA, 201 bp, Bos taurus; identical to SEQ ID NO: 29302

SEQ ID NO: 110196 - DNA, 201 bp, Bos taurus; identical to SEQ ID NO: 29303

SEQ ID NO: 110197 - DNA, 201 bp, Bos taurus; identical to SEQ ID NO: 29305

SEQ ID NO: 110198 - DNA, 201 bp, Bos taurus; identical to SEQ ID NO: 29306

SEQ ID NO: 110199 - DNA, 201 bp, Bos taurus; identical to SEQ ID NO: 29307

SEQ ID NO: 110200 - DNA, 201 bp, Bos taurus; identical to SEQ ID NO: 29308

SEQ ID NO: 110201 - DNA, 201 bp, Bos taurus; identical to SEQ ID NO: 29309

SEQ ID NO: 110202 - DNA, 201 bp, Bos taurus; identical to SEQ ID NO: 29310

SEQ ID NO: 110203 - DNA, 201 bp, Bos taurus; identical to SEQ ID NO: 29311

SEQ ID NO: 110204 - DNA, 201 bp, Bos taurus; identical to SEQ ID NO: 29312

SEQ ID NO: 110205 - DNA, 201 bp, Bos taurus; identical to SEQ ID NO: 29313

SEQ ID NO: 110206 - DNA, 201 bp, Bos taurus; identical to SEQ ID NO: 29314

SEQ ID NO: 110207 - DNA, 201 bp, Bos taurus; identical to SEQ ID NO: 29315

SEQ ID NO: 110208 - DNA, 201 bp, Bos taurus; identical to SEQ ID NO: 29316

SEQ ID NO: 110209 - DNA, 201 bp, Bos taurus
tattaataaaaaataagaaatccagtttttttctcctacccctttggattaccttgatcacttcagggagatcattactctggcctataggaataatggarggttgttaatatagagtagatacatttaaaacacttaaatattatgtaccactttgtttatataaatgttctcacatgaaggacaaggccttcagtttct

SEQ ID NO: 110210 - DNA, 201 bp, Bos taurus
ccttcagctctctacctaagtgtcagcttttctgtgggcctcctcccttaccctgtggcttaggacatttaccgtaatctgaaaataacttatgtatttayggatttttttgtttatcatctggccctgttgctaagttatgaacttcttgagatatttattggcatctactgttagaagagagtcacagctggccttcga

SEQ ID NO: 110211 - DNA, 201 bp, Bos taurus; identical to SEQ ID NO: 29318

SEQ ID NO: 110212 - DNA, 201 bp, Bos taurus; identical to SEQ ID NO: 68921

SEQ ID NO: 110213 - DNA, 201 bp, Bos taurus
tggattgctgagttgattactggagaggagataggaatttttcctaaggaagaaagaattacctaagaggaaagctcaactctttcctttttgaggctcartcttataaacaccactctgacagaccagatctttgaaaagtccagtgacataaaggtctccaatgtccccagggaggaactcactgtgggagaaggtaga

SEQ ID NO: 110214 - DNA, 201 bp, Bos taurus; identical to SEQ ID NO: 68959

SEQ ID NO: 110215 - DNA, 201 bp, Bos taurus; identical to SEQ ID NO: 68963

SEQ ID NO: 110216 - DNA, 201 bp, Bos taurus; identical to SEQ ID NO: 68964

SEQ ID NO: 110217 - DNA, 201 bp, Bos taurus; identical to SEQ ID NO: 68965

SEQ ID NO: 110218 - DNA, 201 bp, Bos taurus; identical to SEQ ID NO: 68966

SEQ ID NO: 110219 - DNA, 201 bp, Bos taurus; identical to SEQ ID NO: 68967

SEQ ID NO: 110220 - DNA, 201 bp, Bos taurus; identical to SEQ ID NO: 68968

SEQ ID NO: 110221 - DNA, 201 bp, Bos taurus; identical to SEQ ID NO: 68969

SEQ ID NO: 110222 - DNA, 201 bp, Bos taurus
ctacttaccagatatctctagagagacacagttaaatatggaaataactcttgtggtggtcccaaagctagttacttatatttgcatagttcccgcctttkctaactataaaatactgcagcagatttttatgtctacttatgtttcacttgccacatcttactatctcctattcatatttttcctcatcttgattgttta

SEQ ID NO: 110223 - DNA, 201 bp, Bos taurus; identical to SEQ ID NO: 68971

SEQ ID NO: 110224 - DNA, 201 bp, Bos taurus; identical to SEQ ID NO: 68974

SEQ ID NO: 110225 - DNA, 201 bp, Bos taurus
atggaattttgactttgtaactgaaaggattccagttcagccagacaagaggattaatcttattcttattatttttaaaaagctctccttaataggtcaayagaattttcactgtcactaaattattagggatttttgttctttcccatctctgcttcatgttatgtggcagcttagatgagaggggaatttggggagaat

SEQ ID NO: 110226 - DNA, 201 bp, Bos taurus
gggtgggccttacctaatcaggtgaacccctctaaaagaaggtttagaaataagagagagaagtcagaggttcaaagcaacagagacagacattttcctgytggccttgatgcagcaaattgcaattttgtagagatatccatgtggaagttaataaacaggtacattctaagaactgagagcagccccagtcaatagccg

SEQ ID NO: 110227 - DNA, 201 bp, Bos taurus; identical to SEQ ID NO: 68977

SEQ ID NO: 110228 - DNA, 201 bp, Bos taurus; identical to SEQ ID NO: 68978

SEQ ID NO: 110229 - DNA, 201 bp, Bos taurus; identical to SEQ ID NO: 68980

SEQ ID NO: 110230 - DNA, 201 bp, Bos taurus; identical to SEQ ID NO: 68981

SEQ ID NO: 110231 - DNA, 201 bp, Bos taurus; identical to SEQ ID NO: 68982

SEQ ID NO: 110232 - DNA, 201 bp, Bos taurus; identical to SEQ ID NO: 68983

SEQ ID NO: 110233 - DNA, 201 bp, Bos taurus; identical to SEQ ID NO: 68984

SEQ ID NO: 110234 - DNA, 201 bp, Bos taurus; identical to SEQ ID NO: 68985

SEQ ID NO: 110235 - DNA, 201 bp, Bos taurus
ataagcagggtctattcaggtggtggtattctgactgaggatcaatttgtgccccgtgagtctgggaggaatggggaacccgggccctggcctgaaggacmaaccacccccaacaggcaaggggatagaagcaacaatgcagacgtgattgaaattacatggctcaatgatgattctcttggcttttgcatgtaaaggctg

SEQ ID NO: 110236 - DNA, 201 bp, Bos taurus
aatgagggttgggacatgtgctgggggtgggggacagagaggggtggtacctcagatctgatcagtgtttagacactgactcatcctaaagaaactcctamggcattaataaatacaaaccagcatagctgtttgctaattttcatgagaaattagagtatatatctttcacacagaccagagattgacagctttgaggtg

SEQ ID NO: 110237 - DNA, 201 bp, Bos taurus; identical to SEQ ID NO: 68990

SEQ ID NO: 110238 - DNA, 201 bp, Bos taurus
ttaacccagtgatcagagaaggcctccataaggtgacatttgcgtaaagagagttacaggagagagtcataagtaattacgggaagaaattgctaaaaagraaaaaagcaaatgaaaaggccttgaggtggggtgcttgcctggaattttgagtggctaaggttggtaaaagaaagagtagtccatgaggtccaagaagca

SEQ ID NO: 110239 - DNA, 201 bp, Bos taurus; identical to SEQ ID NO: 68994

SEQ ID NO: 110240 - DNA, 201 bp, Bos taurus; identical to SEQ ID NO: 68996

SEQ ID NO: 110241 - DNA, 201 bp, Bos taurus; identical to SEQ ID NO: 69004

SEQ ID NO: 110242 - DNA, 201 bp, Bos taurus
gtattcctggtgcaggatctttgggctgggagtccaaagtggagctcagacctgttgcttcttggagagaacctctatagttgtgcctatcctcccatttktggattgcttatgcccactggtgagagtcttgactatactgtgtccttctcctggttttgttgtggcttcttctttatgtctttagtcgtggaaagtctt

SEQ ID NO: 110243 - DNA, 201 bp, Bos taurus
taaataaatttatattaaagttaaaataaatttatattaaaaattaaaaaaattaaaaataaataaataaagctagtacatgttaaactttcttagtaaargatgctggtgtgaacttgcaggagaaagaggcttttcctcttggcatttctggtagatactggacacatttggtggagactggatacagggttgaggaca

SEQ ID NO: 110244 - DNA, 201 bp, Bos taurus; identical to SEQ ID NO: 69005

SEQ ID NO: 110245 - DNA, 201 bp, Bos taurus
tactactattgttttaaaatgtctggatgtttgtggatgattaaaaatggcagaaaagttttgacacatttcccatcagacagtagaatctgttcccctcyactagaagttgtgctgccctgtgattgctttgaccagtggagtatgactccagatctcgactttttagatatctagtagtttccagtcaggctctaggaa

SEQ ID NO: 110246 - DNA, 201 bp, Bos taurus
tatacatttgtgggctttctgcatcactcatgctagcctaaatttcatcagagatgaaatcctagtagatccataggaaaattactcagataaggcactartgaattgtctaaaacatttagtttctggatataaactaatctacgaccacttttcttgtgatgaaaaggaggcctgtcctgtaagagtggatccaggtac

SEQ ID NO: 110247 - DNA, 201 bp, Bos taurus
tagcattaggatacttagctgagcattgattataattacttctctagaatctgctttgtttctagctttcctcttaggttaagttttatcctgaattcatygtgatacagaaattactattttgtaaaacaggggtaaatacaattagcattcacatatcaaatttgtggaatcatataactctctgccagagacctggac

SEQ ID NO: 110248 - DNA, 201 bp, Bos taurus; identical to SEQ ID NO: 69011

SEQ ID NO: 110249 - DNA, 201 bp, Bos taurus
tctgaagagacaacaagacttaaagttctgaagctgacagaaatgttaatagaattggtttgttgcaatccattaatgttcaggaacaagggcccagagtytactctctgccccaaacatacctggctctgtagctctgaagcctcaccttcagaaagaagacatacagatggccaaaaggtacatgaaaattgcttaacc

SEQ ID NO: 110250 - DNA, 201 bp, Bos taurus
tagtgtttttgacctcctcgtttatttatcctcaagtcaattctctgaggcaggcactagtattttcttcaatttatagatgagaaacctgagtcttaaaraaattaaatacttggtcccaaggccagaagctgatcagtaatagtagcctggagattcagacccaagctgtgaggctccagaacctgatgtgcttgtgtg

SEQ ID NO: 110251 - DNA, 201 bp, Bos taurus
tttttcttgtttctagccttagaggaaatgctttctgtgtttcactgttgagtatgatgttagctataggcttgttgtatatggcctaatttattatgtcraggtatgcagagacattactttgctaacaaaggttcgtctagtcaaggctatggtttttcctgtcgtcatgtatggatgtgagagcaggactgtgaagaa

SEQ ID NO: 110252 - DNA, 201 bp, Bos taurus
tctctcaccactacgaaatatattctcataaaattatcaactttaaagataagaaaataagacattgaccactgaaagctagttatctgttatgggaaaayacaaaatttatttcagatgtttccaaaccaactttaaaatctaagtgctataaaatcctcaagggaagaaattgtgatccaaactagtgcacaattgcac

SEQ ID NO: 110253 - DNA, 201 bp, Bos taurus
gaacgtaataggcctacagatgggcagcaacaagggagcctcccaggcaggcatgaccgggtatggaatgcccaggcagatcatgtaagacgccacgtccmgcaacctgtagtgaggacgaaagtgccgcatcgtggtctctatgataaagaagtagttagtcaccttctgaccttctcaaagcctcctgcccctggtttt

SEQ ID NO: 110254 - DNA, 201 bp, Bos taurus; identical to SEQ ID NO: 69016

SEQ ID NO: 110255 - DNA, 201 bp, Bos taurus; identical to SEQ ID NO: 69018

SEQ ID NO: 110256 - DNA, 201 bp, Bos taurus; identical to SEQ ID NO: 69019

SEQ ID NO: 110257 - DNA, 201 bp, Bos taurus
tatcaccaggccagagctcaactgttcatgtccctgagcaccaccgtttggagtttcatagttatgcatggcttacatattagcagggaaaatactggtcrttaaggggcccaggaaagacaaaaagcaagtgatgctatggagggtttgtttttccctattccaaatttgtttagtcaaattagactgaagagtttaacg

SEQ ID NO: 110258 - DNA, 201 bp, Bos taurus; identical to SEQ ID NO: 69022

SEQ ID NO: 110259 - DNA, 201 bp, Bos taurus; identical to SEQ ID NO: 69023

SEQ ID NO: 110260 - DNA, 201 bp, Bos taurus; identical to SEQ ID NO: 69024

SEQ ID NO: 110261 - DNA, 201 bp, Bos taurus; identical to SEQ ID NO: 69025

SEQ ID NO: 110262 - DNA, 201 bp, Bos taurus; identical to SEQ ID NO: 69026

SEQ ID NO: 110263 - DNA, 201 bp, Bos taurus
agaaattacaggatggcaaagtctccttcaataatgaaagtagataaatctagaggaggagaataagtaatttgtaggcaataggttcttaagaaaggagrgggaaattaaaaaaaaaaaatctccagctaagtcagatgattagtttctttatgtaaaataaaagatggtagaaaaactgaacatcaagaataaaagcta

SEQ ID NO: 110264 - DNA, 201 bp, Bos taurus
atttagaggttctttttcacatagtaagaggtgacacaggcagatttcttcaaaatatgtttgtagatgtagtagctttaaccagaacggggttgtgggcrtgacaggcacccaaagtaccacagaccttcctccagcaaggaggaagcccaagacaaagagaccacaaacaagtcaaaaattgatcaaacaaaataataa

SEQ ID NO: 110265 - DNA, 201 bp, Bos taurus; identical to SEQ ID NO: 69030

SEQ ID NO: 110266 - DNA, 201 bp, Bos taurus; identical to SEQ ID NO: 69033

SEQ ID NO: 110267 - DNA, 201 bp, Bos taurus; identical to SEQ ID NO: 69034

SEQ ID NO: 110268 - DNA, 201 bp, Bos taurus
ccataagatactctttttccactgaatcaaaaatcttgacctatttaatggtcagtaagagaagccacatctcccacatcttaagggtcttcactgtagayggaagagatagatacctgaagccttaaggtctcacaggtcagaatttatctggcatccttttcgctagcagctgcagccatttgatgctgaggggggcta

SEQ ID NO: 110269 - DNA, 201 bp, Bos taurus
ctcacaaggcagaagcgtgcggagcagtaagattcttgtgtcccttgtcagttccaaacagttccagatggactgagaaccaggctttttggccaccagcrtgattcttgagtctcagcccacatcttttcctgttcaatccacggggaaagggcaagtgctccttctgcctgttgctttacccattcttcctctggcctc

SEQ ID NO: 110270 - DNA, 201 bp, Bos taurus; identical to SEQ ID NO: 69041

SEQ ID NO: 110271 - DNA, 201 bp, Bos taurus; identical to SEQ ID NO: 69042

SEQ ID NO: 110272 - DNA, 201 bp, Bos taurus
caatctggtcttatggtctttgcttttcaccctcctcctcctgaaacaatctgaacacttggagttttgtcaaattgagttttaacgacttcatagtgccrtgaaaagatgttgcatttcagtaagggtttcagatcatcaagttttaaaactttcttaaacaattgcctcttgacagcagtggcttcttcccattttctg

SEQ ID NO: 110273 - DNA, 201 bp, Bos taurus; identical to SEQ ID NO: 69043

SEQ ID NO: 110274 - DNA, 201 bp, Bos taurus
gcccaaatgactcagaatttctggaagtaggacctcagcatctgtgtttgcttatttgtgttaggctcacaagatgagtctgatgcacagtcagggttggkagtgactgcattttcaaatatatatttagattcattaacctggaggaacaggtgacatgggatatacagagggataaagttaacaaatcagctggatgat

SEQ ID NO: 110275 - DNA, 201 bp, Bos taurus
atcagagggaggcaagctggggtttaatttttttcttctcagaaggaagagattctattgcgtttttaacagcattgttcctctgtgccagccccagtcayatggaaacctatttgggatgcagccaaggggctacgctgtccatgatggaggatggctacaccagagagcaagcaaagattaatcaatccaagacaacat

SEQ ID NO: 110276 - DNA, 201 bp, Bos taurus
gaatctgaccacatcttgtgaactttaggacaacatacacattcgtcaaagccaccactgactctcatatgcatgattccaacagcctcctaccatgttgytctgctttcactacttttcccctatttattctccccagagtagagaacagctggaattattttttgacatcctaaattaagatcgtgtccctcctctgct

SEQ ID NO: 110277 - DNA, 201 bp, Bos taurus
ggtgggattcactaccgtaatgattttctgccattccctctctactgtctttttctccccttgcagctctttgagtttttatatttgtttttcttagccayaggtaataactaaaagagaacaattgagtcagacattctctgccacagttagaatttcagcacagacatgctttatatatgaatcctggtgaagaggaaa

SEQ ID NO: 110278 - DNA, 201 bp, Bos taurus; identical to SEQ ID NO: 69044

SEQ ID NO: 110279 - DNA, 201 bp, Bos taurus
ggaatcagtgaactagaatggaccggaatgggggaatttatttcagatgaccattatatctactactgtgggcaagaatctcttagaagaaatggagtcayagtcaacaaaaggcattagtatcccaactttacagataagacaattaaggcttaagccatataaacttttctgaagccaagtggtttctacatggtagaa

SEQ ID NO: 110280 - DNA, 201 bp, Bos taurus
ggcctggagaaagaaacaaataaccaacaatgatttttgtctgttgaggttgttgaagtataattgcaattttttaccagagagtctacagaagtgctgtrgaaaggcagaatttggcctatattatctacaggaaagggctatactgcctatgtgaatacagttagcctgaatgataacacaactatagcaactctgctc

SEQ ID NO: 110281 - DNA, 201 bp, Bos taurus
attttattatttattacaatctgcacgattaaagagttaaaagaaaaaaataatccaaattaatctctttattctgattttttggggaggggattggaaakggcagtccaccattggccaatatgatgtttttattttactatttgtaaattaaactgactcaatctatctgcatttactatgatgatacgtaaatgaaat

SEQ ID NO: 110282 - DNA, 201 bp, Bos taurus
ataattgtactaattttaacagttctctgccactcctcatcctcctaactatcttaattccatctattttatctatgagccactgttattatcctccaggkctttcatgacctaataaccccttgataggaatttcacagccaacaatttccatcactctcatgtcatattagtgaaataaaactgtagaaatggtgaggc

SEQ ID NO: 110283 - DNA, 201 bp, Bos taurus
gatatctctgtaacacaaagaactgatcacatttaacagcagatcattctgttagaaagttctgtatactgaggcagggtgatcggcctcataactaccayccactgtcccagtttggcagcctcggttcagaaccaaatatcaaatgtcccactgggcagctcttcaattagatgaaggcagccatcaggccttcatgct

SEQ ID NO: 110284 - DNA, 201 bp, Bos taurus
ttggacagggcctaattacagctctgtaaatgcaagctaattggtgactaaaagtttaagacaaaagattgacttccactcttgtaattgaagaatttgargtgttaggccatgtgtcttatgtatatattgtttctattaggataacggctaaaatttaataacaaatatgttagcaaaataatctcaatattgatatat

SEQ ID NO: 110285 - DNA, 201 bp, Bos taurus
atcagtcagaattttagattgggttttaattttaggtaactgagcagttatagcactgctagagttattcaatacactttaagggccaacccatattcctrgtaagcaatgcactgctatctgcctaacaaggatggagcgcagggaataatgcataagtattggtgaatgatcttggtggccacaaacaaatgacaagag

SEQ ID NO: 110286 - DNA, 201 bp, Bos taurus
cttttttgttttcttttcctattggacattacacctaagtctctacatataaacaaataaatccatgactgcagatcaagtaccaggtctgggattcacarctcaggaatatatgtctcccacgtttctctcatcacagcccctcagtcttccatgtggctctaagattttactgctggaacagagtcaggggagggacaa

SEQ ID NO: 110287 - DNA, 201 bp, Bos taurus; identical to SEQ ID NO: 69049

SEQ ID NO: 110288 - DNA, 201 bp, Bos taurus; identical to SEQ ID NO: 69050

SEQ ID NO: 110289 - DNA, 201 bp, Bos taurus
gaagtattaaatatgaattcacaatttaaaagtatatttatacacacacaactgttcaatttggtcatcaaaagaataatgaccataactgattatatgayactaattagaaagtttccattttaatcctagagataaagggataacataaaattaacacacataaaatatatgctctacttagaggtgacttttacatca

SEQ ID NO: 110290 - DNA, 201 bp, Bos taurus; identical to SEQ ID NO: 69052

SEQ ID NO: 110291 - DNA, 201 bp, Bos taurus; identical to SEQ ID NO: 69054

SEQ ID NO: 110292 - DNA, 201 bp, Bos taurus
ttcatccattccttgacctttgcatttggttagttttcccttaccacatgctgtagctggtctgtattaaaaaagtcacagaatacactgtttaccaagaygtctccaaacccagtgattccagatccactgttggtgctcagcctgctggctcctgggttgtgactctgctctggcatttagcatctgctgttggcactg

SEQ ID NO: 110293 - DNA, 201 bp, Bos taurus
atgggttactctcaccaccaaaagctatcatgcatcattcattcatttatttgttcatcattctgacagatttgatgatagttttactattaaataggccstatggcatgaaagaaatgatatctaaaattgaaccatttaggagggtaggaaggagtgttccagattgaggaaactgcatacaaaggcctgcctatgaga

SEQ ID NO: 110294 - DNA, 201 bp, Bos taurus
tctgggtagtcacatactataattgacatacacaaacagtccacaaatgaagttttatagactttcttctaagggaaatgaataatcatagtttagaacaytggaagaagaagaaaaaaaaaagtctacagaatcaaggactattctcttaaattttcctgtagaggtttattattttagttaagaaacactaaaatttga

SEQ ID NO: 110295 - DNA, 201 bp, Bos taurus
agacatgtgattataagattagactgtataaatataaaatgaaaattgtaatcaagctctagggatgcaagcaaggtaattgaaagtgagaagggacccartattagaaatcttagttctaccatgcttagttactttgagaaagtgtgtgtgttacactaaagtcttaagaactgtttctcaagcaagactatataataa

SEQ ID NO: 110296 - DNA, 201 bp, Bos taurus; identical to SEQ ID NO: 69058

SEQ ID NO: 110297 - DNA, 201 bp, Bos taurus; identical to SEQ ID NO: 69059

SEQ ID NO: 110298 - DNA, 201 bp, Bos taurus; identical to SEQ ID NO: 69060

SEQ ID NO: 110299 - DNA, 201 bp, Bos taurus
ttcatcttttcttcctccaatgtaagaaaccacagagcagacagcagatctgtcattcttagcaattctgctcccaggtggcgtcttgagcttggccccgygagctcccattcccttcctagctaggtgctcccactcagagcggtgtcttctcccacccgcctgggtccccgaatcggagacctcagcgtcccctggagg

SEQ ID NO: 110300 - DNA, 201 bp, Bos taurus; identical to SEQ ID NO: 69063

SEQ ID NO: 110301 - DNA, 201 bp, Bos taurus
aaccatggccgccttttggaggcagggcacgtgcaagtcaggtgctgaaaagcgggaagcctcacagacctaacgttattctgcagttctgctgagtcacratatcttttgttcctgccagagctcatctcagtagaaatagcctcacttatcatttgccaaaagtggcatgcttttaaagattcctgcttttattcaata

SEQ ID NO: 110302 - DNA, 201 bp, Bos taurus
ccctccaggtgaaaattggggaggacatctagagtacagctttatgaatgggttcgagttctttactcatttacccctcagcttgacaggggcctgggtaytctctctctgcattgtgagcctggctcctctctctctcctcatctgcttatttactcaattgaaaacaggttttctgctcagcctttccagttctctctg

SEQ ID NO: 110303 - DNA, 201 bp, Bos taurus
actttgtttcaaaacaaaaaaaggattttcagtgtagaaagtactcttataaatagtctcataatctaatgagctctgtagtagtaaccagttctgctttmagcctaggtggatagccaaatgttacatgagcctttatcattaggaaacttaagcctctcagacgcctctgtgccttgtcacagtctgcatgtcctttcc

SEQ ID NO: 110304 - DNA, 201 bp, Bos taurus
aggcatagtaggctgaacccttgacagtctcatcctcaatttgctcacaggaacagctcccatgctgggagggccaacttgtgaagactagggggtgccaytgctattgcccctcttttggtgccttctcatacagtgggggtgtaactctgggaaaagtgagtcctcatccagttctagggtaggagtgcaggagttctg

SEQ ID NO: 110305 - DNA, 201 bp, Bos taurus; identical to SEQ ID NO: 69069

SEQ ID NO: 110306 - DNA, 201 bp, Bos taurus; identical to SEQ ID NO: 69070

SEQ ID NO: 110307 - DNA, 201 bp, Bos taurus; identical to SEQ ID NO: 69071

SEQ ID NO: 110308 - DNA, 201 bp, Bos taurus
ttcattaaacaattaccatgaattatttttgacagatgccccagggaaaaggctatatatactgaatggggtctgggccagatcaaataaagacctgtgakttggggcttccaaggagatatcaaacaagtaatacaatgataattctctcatataggagtattccaaatcaattttgaattttttaccattggccattag

SEQ ID NO: 110309 - DNA, 201 bp, Bos taurus
gtaagggaaaactgaagataaagtgtcatcaatgataatggagaatttaggaaggtacaacattttgaaggtgatactttctggcctgttaagtcttaccrtcattaaaataggtatctctggaagtagctgaagatttaggactaaaaagaagacagggctaatgtttgcatcttccttcctcttggcctgattgtttct

SEQ ID NO: 110310 - DNA, 201 bp, Bos taurus
atagagtagccttgtttgatgttgtttttctgtgaaattgttcatgttcaacaggagagcaccatggcctgcctaactgttagtacagggcaagctccagyagacagctgttagaggctgctattttttttatcttttggcaatttattacttttaaagtagcttttggtaagcaggcctggttcaatatttagacaagag

SEQ ID NO: 110311 - DNA, 201 bp, Bos taurus
aaggagataaaattttacagcctcttatatgcctatagagagttgaagccaaaggtagtatgatctaggtcagaaaaattacatgtttcttaagtgttatygctataataattctgtgttaaaatatttttcctttggaatatagaatgatatatcaactttcttcctcctctacttgtttttaattgttatttcattagg

SEQ ID NO: 110312 - DNA, 201 bp, Bos taurus; identical to SEQ ID NO: 69074

SEQ ID NO: 110313 - DNA, 201 bp, Bos taurus; identical to SEQ ID NO: 69075

SEQ ID NO: 110314 - DNA, 201 bp, Bos taurus; identical to SEQ ID NO: 69076

SEQ ID NO: 110315 - DNA, 201 bp, Bos taurus; identical to SEQ ID NO: 69077

SEQ ID NO: 110316 - DNA, 201 bp, Bos taurus
tggtattagggaacctgtctgtgaatccagcagaatttcattaaaagtagagtcagatgttgggatggctaactctcctgcatcattagaggttgtgcagyaaggctggcaataagaataggacccaaccctgggctgcagctgttctaaataaacaacaattcagaaactctgttttcagttcaatcctgggcccccatg

SEQ ID NO: 110317 - DNA, 201 bp, Bos taurus
agagccagagaaattgtggaaaaaagaaaattgtccaggctgtatgagggcatggatgtgtctaatttcttcaccagtgaatctcaggcccctaagatagyacctcaaaattatttgtataaggactgaacaggacattagcatatcctggtgaaagcatctcctcttgtgtattaaattctctaggccttccgtgttcca

SEQ ID NO: 110318 - DNA, 201 bp, Bos taurus; identical to SEQ ID NO: 69081

SEQ ID NO: 110319 - DNA, 201 bp, Bos taurus; identical to SEQ ID NO: 69082

SEQ ID NO: 110320 - DNA, 201 bp, Bos taurus
agtctgttctacacaaagcattagaatatcctatcattgatcaaataaactttttcctgtcctagtcttaccaattttctagcctagtctttatttttgarggccatgcttatcaaacagtcatcctaggcctgtttaaagatctctgttacagataatactgttggcttttaatgggctttctccatagaggaacatttg

SEQ ID NO: 110321 - DNA, 201 bp, Bos taurus
ccatctcttcagaagaaaaactggattattgcattctatctcaaggtgttctattttcatatgtgtacaaacatcctcttgaaggttctcagtggtatgcycctaatatttctgtagggaaactcaatatttaatattgtattatgtcttcattaattgaattagctgtaatagggaaataaataaactcatgattagaca

SEQ ID NO: 110322 - DNA, 201 bp, Bos taurus
aatttatttaagcccttgtttttcaggtctcaggtatcattaaccaagcaccattcctattccacacaattggatttctcatgcctacaacccacatgccyaagacaatcaggaatttctctttctaatatgtttaggtggtctggatttctccactggcagtgtgtagtggaggccatgccaccttcctgaggcttgcag

SEQ ID NO: 110323 - DNA, 201 bp, Bos taurus; identical to SEQ ID NO: 29325

SEQ ID NO: 110324 - DNA, 201 bp, Bos taurus; identical to SEQ ID NO: 29326

SEQ ID NO: 110325 - DNA, 201 bp, Bos taurus; identical to SEQ ID NO: 29327

SEQ ID NO: 110326 - DNA, 201 bp, Bos taurus; identical to SEQ ID NO: 29328

SEQ ID NO: 110327 - DNA, 201 bp, Bos taurus; identical to SEQ ID NO: 29329

SEQ ID NO: 110328 - DNA, 201 bp, Bos taurus; identical to SEQ ID NO: 29330

SEQ ID NO: 110329 - DNA, 201 bp, Bos taurus
aggcaagtttggccttggagtacagaatgaagcatggcaaaggctaatagagttttgccaagagaacacactaatcatagcaaacacccttttgcaacaayacaagactgtactatatggccaacatcactagatggccaacaccgaaatcagattgattatattgtttgtagccaaagatggagaagtgctatacagtca

SEQ ID NO: 110330 - DNA, 201 bp, Bos taurus
gccgaatgctgcgcttcatagtcccgggcgcgcaaccagaacctctcttcgacccaccgcacggcgccttgggtttgcgcaatagacccctcccggccccrgctcgtcacactcggctgcagggtgagagaagtccacagaacgccggcgaacgctgcgggactggggcggggcggggccgagaggggcggggcggaggag

SEQ ID NO: 110331 - DNA, 201 bp, Bos taurus
caatccaccttgataatttcatagtagggcccagaaaaaatgaagctgatataggctgagcaggatcacattatggctttcgtgaatctcaggtaaatttkcttctgtgggccctcttccaccattaaaaaaaaaaaaaaaaaaaagtatgtttacaactctgttggtatatgacagatacagtaatatattaaaatattt

SEQ ID NO: 110332 - DNA, 201 bp, Bos taurus; identical to SEQ ID NO: 29333

SEQ ID NO: 110333 - DNA, 201 bp, Bos taurus; identical to SEQ ID NO: 29334

SEQ ID NO: 110334 - DNA, 201 bp, Bos taurus
acatgggcccaggccttgaggcagggctgaacctctctccatccctgccttgcagcctaatagtgctggcaggctgccttgggacctagcacccactatayaggctgcatgagaagtctgagggccaactgggtcctgggcacctgactccctcagcaatgacagctgagcagggtttggggacatggccttgaaggagca

SEQ ID NO: 110335 - DNA, 201 bp, Bos taurus; identical to SEQ ID NO: 29335

SEQ ID NO: 110336 - DNA, 201 bp, Bos taurus; identical to SEQ ID NO: 29336

SEQ ID NO: 110337 - DNA, 201 bp, Bos taurus; identical to SEQ ID NO: 29337

SEQ ID NO: 110338 - DNA, 201 bp, Bos taurus; identical to SEQ ID NO: 29338

SEQ ID NO: 110339 - DNA, 201 bp, Bos taurus
attgctcaagagctgattggaaagacagaatcccagacttaggaatctgaacctcattttatcttcaagtaaattatgtgcactttaaagtttgagaagcrgtattcttggccacagctgtaccttttcaaggccttattacagaaggggaaaactgatggagaaccttgtctggactcaaggtttcaccctatagcttgt

SEQ ID NO: 110340 - DNA, 201 bp, Bos taurus
atgtcacctgagaccaaggacagtcccagcagctgtgttgcctggtcagctcatcacaggctaacaccaccaccactgtgactcacttcccttctctcctkctgtctgctctctgctttcacttctgctctgcaaaaagctacccagaaccctgtctctatggtccacgttcccagaaaatccacccagcatgttgcccct

SEQ ID NO: 110341 - DNA, 201 bp, Bos taurus
gtcaaggttgatccaaagccaggcctgggtagcctgctcctatctaatcagggtctcatgaagccctcccagacaacccagggaggtctgtggctgccacrgtattctggggaccttactcaaagtttcctggactggtcatctctgactcccccagaactggaggataattggagatcacagccagtgaacaaagtggac

SEQ ID NO: 110342 - DNA, 201 bp, Bos taurus
atcttccccacccagggatagaacctgggactcccgcattacaggcagattctttaccgtctgacccaccagggactaggcctcaagaaggaaagcctccycactgaactcctgtccccaggtggcacgtcacagtagttcactgggctcatggtggcactgctgggcccttgactgaaaatcctccatctttagggagga

SEQ ID NO: 110343 - DNA, 201 bp, Bos taurus
ctaaactgtgttgctatgttgaaattaactctgagcacagaagcaggtgctgagggaaagcaggcatcatggcactgctagcgttttcagacacagatgaygaataagatatacaaagttaacctattcaatatgaattttctgaagggataagtataggtagcactttattgcaatgtcccttgcagaagaaaatggctt

SEQ ID NO: 110344 - DNA, 201 bp, Bos taurus
aatgaggctcctcttctgtgaccactgtggactgacggtgaaggcccccagttctggagattctctgctttccactctcaggttccagaggatggtcacgygcacagcagcccttcctctgcccagccttgttatctgaacctcattgagatgcttctggttcccgccttggggctgctggcctgattcatcctttcccag

SEQ ID NO: 110345 - DNA, 201 bp, Bos taurus; identical to SEQ ID NO: 29342

SEQ ID NO: 110346 - DNA, 201 bp, Bos taurus; identical to SEQ ID NO: 29343

SEQ ID NO: 110347 - DNA, 201 bp, Bos taurus
gtctttgcagctgaaatgagagagcaacaacttttctctaaaagttttgagctctcccttccacatgctgggcagttcgtgctcctgtggccatctccagytgggatcatttgagactctgttaatgtatctgagagcacatgcctggtctcagagtggagagatgctgagaggagttgtcaaaaagagcagttcttagag

SEQ ID NO: 110348 - DNA, 201 bp, Bos taurus; identical to SEQ ID NO: 29344

SEQ ID NO: 110349 - DNA, 201 bp, Bos taurus
ggcccagaatgcccagtgcctgcagctgctgcatgtaactatatctgggtttgacctgaacatctgcttctgtatccacagaaaacattatttggccccaygtgagttatgagcttttaggaagaacaaagatagaacagagtgaggaaacagaaaacatgacaaaaaccaggcaagagcaggaggtgggaagacacttga

SEQ ID NO: 110350 - DNA, 201 bp, Bos taurus
cccaaggtaccttgtctggcctctggttatggccataacagcctacgtcctgggccctttgaggggataagattcttcactggggcatttgaaatatattytgcagcctcattccccttcttgtggccaaatccctaaacttccctcatttattaccctcagtgtcccccttcctaggcctggggacaggacttaccgtta

SEQ ID NO: 110351 - DNA, 201 bp, Bos taurus; identical to SEQ ID NO: 29347

SEQ ID NO: 110352 - DNA, 201 bp, Bos taurus
ggcacatgttactacacgaatgaaccttaatgacatcatgttaagcgaaataagccaatcacaaaaagacaaagacacgaggtacctggggtgatcagtaygtggagacagacagtaggaaagtgctgcaggtgtgggtgtggagagctgttattcaacgggtagggtttccgctttgtaggatgaagagagtcctggagt

SEQ ID NO: 110353 - DNA, 201 bp, Bos taurus; identical to SEQ ID NO: 29350

SEQ ID NO: 110354 - DNA, 201 bp, Bos taurus; identical to SEQ ID NO: 29351

SEQ ID NO: 110355 - DNA, 201 bp, Bos taurus
tcaagagcacacagaggctctctgctgggactcacctcagagatgtggtggccccttgcctttgttcccttgggaaataaaaacttgtgctaaggaagcakggtagtagtcattctggaagggcctaaatttatcttccaactggtcttggagaaaacaaacacaatcattctcaccctcctttaaaggtccctttactga

SEQ ID NO: 110356 - DNA, 201 bp, Bos taurus; identical to SEQ ID NO: 29358

SEQ ID NO: 110357 - DNA, 201 bp, Bos taurus; identical to SEQ ID NO: 29359

SEQ ID NO: 110358 - DNA, 201 bp, Bos taurus
ctccttctcagcaccttcccctaactggtgcccctctccctccagccactcacaacccagccagtctggaaggagctggaagtcaagcaaacagctggacytgatcagctgcagtggccccagaccagctgatcctcactctctgagctgttgagcgcgtttaggctgcagcgggtggaggtgcggtggaaaaggcctcac

SEQ ID NO: 110359 - DNA, 201 bp, Bos taurus; identical to SEQ ID NO: 29363

SEQ ID NO: 110360 - DNA, 201 bp, Bos taurus
ttctttctgacacatatgaagtgtcagtgagaaggtactgccttgagcaagtaaccataggacgggctggcctgtaggtcaactggaactaggactcaaarccctcagagttgctcctgtaaccttggaggttactcctccatccctccattgcagccagagctccaggaccccagccccatccaggccccaagaccaaaa

SEQ ID NO: 110361 - DNA, 201 bp, Bos taurus
gattatagtccatggggtcacaaagagtcggacacgactgatgaactgatgaacacacacacacacacacacagatggtatttatatactttccttttagmtatcagccttggggaacaaaccttctaacacttgggggttggaaacttctggtctcttccaaagagttcctcacttgtcctgccttgtagtactcgacag

SEQ ID NO: 110362 - DNA, 201 bp, Bos taurus; identical to SEQ ID NO: 29364

SEQ ID NO: 110363 - DNA, 201 bp, Bos taurus; identical to SEQ ID NO: 29365

SEQ ID NO: 110364 - DNA, 201 bp, Bos taurus; identical to SEQ ID NO: 29366

SEQ ID NO: 110365 - DNA, 201 bp, Bos taurus; identical to SEQ ID NO: 29367

SEQ ID NO: 110366 - DNA, 201 bp, Bos taurus
cagccatgcccactggtttctgtatctcagttgtgagctggccagaaacttctttccctcacttctccaatctttcctgaccacctttagcctttctcttractagcttggccagtgtcatagcatggtagcctccgtgtaagtcagacttcttatgtgaaaggtgaaggcttctaaagtgaatgtgccaagagactggaa

SEQ ID NO: 110367 - DNA, 201 bp, Bos taurus
aaccgtttgttttcaaaattaagaacttgtcattatggtgccaccctacctctaatattagtatctattcttattatttagaatagattctattctgtgcmtttacacaggacctaaatttggataaaaggtaaacataaattacaaaaccttgggcaaactcttctttgaagcttttcatcagcagagtagatggatcat

SEQ ID NO: 110368 - DNA, 201 bp, Bos taurus; identical to SEQ ID NO: 29368

SEQ ID NO: 110369 - DNA, 201 bp, Bos taurus; identical to SEQ ID NO: 29369

SEQ ID NO: 110370 - DNA, 201 bp, Bos taurus; identical to SEQ ID NO: 29370

SEQ ID NO: 110371 - DNA, 201 bp, Bos taurus
aatgtcatcttaacccactccctcagcagtctgagcttctgtgtatgcatatataaatcaggtatataataatactaatgatagttattagctgatggccrtgaggattgaatgggagtcatgctcttcataatagttttcattttttaaaaataaagcctgtcatgatctttaattaaaaaattaaatcttataccagag

SEQ ID NO: 110372 - DNA, 201 bp, Bos taurus
cgttgatgaaatagtaaatttcaggagtaaacaaaaataattacgatcttaaggcagaagctactaaaatctgttattttatatccagttagtatggcctrttattgtataaagggaagatatgtgcaaaatactagagttatctctgcacagtaaataactcatattaggggaaaatgaaattcttcatattgttgtgca

SEQ ID NO: 110373 - DNA, 201 bp, Bos taurus; identical to SEQ ID NO: 29372

SEQ ID NO: 110374 - DNA, 201 bp, Bos taurus; identical to SEQ ID NO: 69087

SEQ ID NO: 110375 - DNA, 201 bp, Bos taurus; identical to SEQ ID NO: 29374

SEQ ID NO: 110376 - DNA, 201 bp, Bos taurus; identical to SEQ ID NO: 29375

SEQ ID NO: 110377 - DNA, 201 bp, Bos taurus; identical to SEQ ID NO: 29376

SEQ ID NO: 110378 - DNA, 201 bp, Bos taurus; identical to SEQ ID NO: 29378

SEQ ID NO: 110379 - DNA, 201 bp, Bos taurus
tcactttatgtgttactgtctggatctgaaaattagaggtacattttattttaaatcattcagcatttcaatctttttatacctattaggatatactggcytttgtaaaatgttaaactcatttcaaatgtgtgatttgatatgaaggaagaaacagacacaaggaaagaggagatttgagcagcattggtttgcgagaaa

SEQ ID NO: 110380 - DNA, 201 bp, Bos taurus; identical to SEQ ID NO: 29379

SEQ ID NO: 110381 - DNA, 201 bp, Bos taurus; identical to SEQ ID NO: 29380

SEQ ID NO: 110382 - DNA, 201 bp, Bos taurus; identical to SEQ ID NO: 29381

SEQ ID NO: 110383 - DNA, 201 bp, Bos taurus; identical to SEQ ID NO: 69101

SEQ ID NO: 110384 - DNA, 201 bp, Bos taurus; identical to SEQ ID NO: 69102

SEQ ID NO: 110385 - DNA, 201 bp, Bos taurus; identical to SEQ ID NO: 69104

SEQ ID NO: 110386 - DNA, 201 bp, Bos taurus; identical to SEQ ID NO: 69105

SEQ ID NO: 110387 - DNA, 201 bp, Bos taurus; identical to SEQ ID NO: 69106

SEQ ID NO: 110388 - DNA, 201 bp, Bos taurus; identical to SEQ ID NO: 69107

SEQ ID NO: 110389 - DNA, 201 bp, Bos taurus; identical to SEQ ID NO: 69108

SEQ ID NO: 110390 - DNA, 201 bp, Bos taurus; identical to SEQ ID NO: 69109

SEQ ID NO: 110391 - DNA, 201 bp, Bos taurus; identical to SEQ ID NO: 69110

SEQ ID NO: 110392 - DNA, 201 bp, Bos taurus; identical to SEQ ID NO: 69111

SEQ ID NO: 110393 - DNA, 201 bp, Bos taurus; identical to SEQ ID NO: 69112

SEQ ID NO: 110394 - DNA, 201 bp, Bos taurus; identical to SEQ ID NO: 69114

SEQ ID NO: 110395 - DNA, 201 bp, Bos taurus; identical to SEQ ID NO: 69116

SEQ ID NO: 110396 - DNA, 201 bp, Bos taurus; identical to SEQ ID NO: 69117

SEQ ID NO: 110397 - DNA, 201 bp, Bos taurus; identical to SEQ ID NO: 29385

SEQ ID NO: 110398 - DNA, 201 bp, Bos taurus; identical to SEQ ID NO: 69118

SEQ ID NO: 110399 - DNA, 201 bp, Bos taurus; identical to SEQ ID NO: 29388

SEQ ID NO: 110400 - DNA, 201 bp, Bos taurus; identical to SEQ ID NO: 69121

SEQ ID NO: 110401 - DNA, 201 bp, Bos taurus; identical to SEQ ID NO: 69122

SEQ ID NO: 110402 - DNA, 201 bp, Bos taurus; identical to SEQ ID NO: 29389

SEQ ID NO: 110403 - DNA, 201 bp, Bos taurus; identical to SEQ ID NO: 29394

SEQ ID NO: 110404 - DNA, 201 bp, Bos taurus; identical to SEQ ID NO: 69127

SEQ ID NO: 110405 - DNA, 201 bp, Bos taurus; identical to SEQ ID NO: 29395

SEQ ID NO: 110406 - DNA, 201 bp, Bos taurus; identical to SEQ ID NO: 29396

SEQ ID NO: 110407 - DNA, 201 bp, Bos taurus; identical to SEQ ID NO: 29398

SEQ ID NO: 110408 - DNA, 201 bp, Bos taurus; identical to SEQ ID NO: 69129

SEQ ID NO: 110409 - DNA, 201 bp, Bos taurus; identical to SEQ ID NO: 29400

SEQ ID NO: 110410 - DNA, 201 bp, Bos taurus; identical to SEQ ID NO: 29401

SEQ ID NO: 110411 - DNA, 201 bp, Bos taurus; identical to SEQ ID NO: 29402

SEQ ID NO: 110412 - DNA, 201 bp, Bos taurus; identical to SEQ ID NO: 69133

SEQ ID NO: 110413 - DNA, 201 bp, Bos taurus; identical to SEQ ID NO: 69134

SEQ ID NO: 110414 - DNA, 201 bp, Bos taurus; identical to SEQ ID NO: 29407

SEQ ID NO: 110415 - DNA, 201 bp, Bos taurus; identical to SEQ ID NO: 29408

SEQ ID NO: 110416 - DNA, 201 bp, Bos taurus; identical to SEQ ID NO: 69137

SEQ ID NO: 110417 - DNA, 201 bp, Bos taurus; identical to SEQ ID NO: 29415

SEQ ID NO: 110418 - DNA, 201 bp, Bos taurus; identical to SEQ ID NO: 69147

SEQ ID NO: 110419 - DNA, 201 bp, Bos taurus; identical to SEQ ID NO: 69148

SEQ ID NO: 110420 - DNA, 201 bp, Bos taurus; identical to SEQ ID NO: 69150

SEQ ID NO: 110421 - DNA, 201 bp, Bos taurus; identical to SEQ ID NO: 69151

SEQ ID NO: 110422 - DNA, 201 bp, Bos taurus; identical to SEQ ID NO: 29420

SEQ ID NO: 110423 - DNA, 201 bp, Bos taurus; identical to SEQ ID NO: 29425

SEQ ID NO: 110424 - DNA, 201 bp, Bos taurus; identical to SEQ ID NO: 29428

SEQ ID NO: 110425 - DNA, 201 bp, Bos taurus; identical to SEQ ID NO: 29430

SEQ ID NO: 110426 - DNA, 201 bp, Bos taurus; identical to SEQ ID NO: 29431

SEQ ID NO: 110427 - DNA, 201 bp, Bos taurus; identical to SEQ ID NO: 29434

SEQ ID NO: 110428 - DNA, 201 bp, Bos taurus
tttttttcctatcggccaactcatgtctttaacaactttgaacagaacattacaagaagaaaaatataagactggttaagctaaggtttgggaaggctacraatgcctgctaacagtgctacctctatttcctgtcatcccagagaaggaggagtcacatgggcacagtaaaacctccttgtgatgaaccccactacgaca

SEQ ID NO: 110429 - DNA, 201 bp, Bos taurus; identical to SEQ ID NO: 29438

SEQ ID NO: 110430 - DNA, 201 bp, Bos taurus; identical to SEQ ID NO: 29439

SEQ ID NO: 110431 - DNA, 201 bp, Bos taurus
gaatgaaatgagcgaggaaaaatctggaggcaaggctaatgccataattcagggaaaaaatgctgaatccctgaaccaagggcagtggcagaaaagatgtrggaagaaaactggcttgacagacttgaaggagacagaactgataggactggcaaatggatggtgactcaaggacactctcagacttcaggctttgacagc

SEQ ID NO: 110432 - DNA, 201 bp, Bos taurus; identical to SEQ ID NO: 29440

SEQ ID NO: 110433 - DNA, 201 bp, Bos taurus; identical to SEQ ID NO: 29442

SEQ ID NO: 110434 - DNA, 201 bp, Bos taurus
gtgactccacccagtcctgtatttctctaaagcccaggcccattgtgtggtactgcactgctcccccacagtggaaaagaggctattatacgagcttagcrgattcctatccgtgtcctgagacgtcttagttagaaagattaaacaaacaaatgaagaaaaccccttgagctgcccattggtcagattttcattctaaac

SEQ ID NO: 110435 - DNA, 201 bp, Bos taurus; identical to SEQ ID NO: 29445

SEQ ID NO: 110436 - DNA, 201 bp, Bos taurus
attgactccaaagagtcaacctgagcaggaggtagcgtgggggctttcagttgcagcgagtgaggacgctctaatatgccagctcctatagtctgtaggtycaccctttatatcatctctcttttcatcctaaagcattgtctttgagaaatccaggttaaagtaacatggactttgggcttggtcatgtattcttatcag

SEQ ID NO: 110437 - DNA, 201 bp, Bos taurus
gcctctgtctcctatgtaccaatacaaagcaaacaacttcctagtctccttctcctccagccgttagtagaacctggctgcttgatgacagcacacagatycactcccctggagtggccccaaagcgctgagcacactcccagtgggcctccagagttaaccacattaaccactacagtcagacagcattaaacccacgta

SEQ ID NO: 110438 - DNA, 201 bp, Bos taurus
cactgcccctgcataagcaaggcaatatagctcctttgtctcaggccccccgccgcccctgcttaagcaaggcaacatagctcctttgtctcaggctcccytttttttatcttaatacagaggcctctcctttcacaatcaactaaggtcaataatcagagtgtcatcctaaagaaaagtaattttttttcctttttttct

SEQ ID NO: 110439 - DNA, 201 bp, Bos taurus; identical to SEQ ID NO: 29447

SEQ ID NO: 110440 - DNA, 201 bp, Bos taurus; identical to SEQ ID NO: 29448

SEQ ID NO: 110441 - DNA, 201 bp, Bos taurus
aaaaagaaccatacaggccaaggaaaacccagagagcaatttcagggactaatagcccacttcccattcagatctgggcctagagtgcggcctggggcagktcccaccttgcctcccagtgccctgtctttgttctgtgctggtaaaatcagaatgaatgaaagtcaagggcagccagaggactgcgggggctagggggga

SEQ ID NO: 110442 - DNA, 201 bp, Bos taurus
tcccatggctttccgtttcactcagagtgaaagtcgaagtcccaacggtgtcatttaagactccatcgggtcccaccacctaccggccaaccagtttaacyctcttgctttctcattgccattccagcacaccagccttttcactgcttctccaaagcaacagccattctctgtgtcacaacctttgagatggccccagcc

SEQ ID NO: 110443 - DNA, 201 bp, Bos taurus; identical to SEQ ID NO: 29449

SEQ ID NO: 110444 - DNA, 201 bp, Bos taurus; identical to SEQ ID NO: 29450

SEQ ID NO: 110445 - DNA, 201 bp, Bos taurus
tggaaccccagcccctggcccaccggggaagtcccaggagttgcctttcaagtgaggaagagtgatggctaagctcagaagccaggaaataaggtgggctwaagaaataatggccaatatagaactctgggtgttactgatacatcaatcaaaccagaataaaaaagatcagaaatctgtcttttattgaagcaaacttta

SEQ ID NO: 110446 - DNA, 201 bp, Bos taurus
actagaagcaaggagaacctacagcaataatccaggtgagaaaggagcctcacttggcagtggcagtgagagagagaagactcgggtcaaattctgtgtgrgtctggaaggtagagaaagactggatacaggagtgagtgtgtgagaaagggaggagtcaggggtgactccaaagattttggcttgagcaaccaaagagat

SEQ ID NO: 110447 - DNA, 201 bp, Bos taurus
agggggtagtgtttttgagacaaattttatttgaaatttgtatttgaattaagctttggtcctcctggcaatcaaaactaagagaaggatagtgaatggtraaagtctattactgcttcttttttttgaacaattagtgtatgctaaactgcatattaataaatttaaaccctagtgtaatattataatatgttgatcact

SEQ ID NO: 110448 - DNA, 201 bp, Bos taurus
tagtcagggggcaagtgaaaaggagagtcaaataatggtcgctcaagtgtttgccgtttcgatctctgatatgtgttcaaaatctcaaaggaaatctgagkaaatttcctgttcatcggaaagcaattattctaagggcagagacaaatgcttggttagtatgtggaggtgccctaagcacgaacggtgttctaagtgcct

SEQ ID NO: 110449 - DNA, 201 bp, Bos taurus
aaggggtcagagtgaattcaagtaggccagttagaaggctattaatatagaattaaatattttgcttccattttaactagagaccattggatctttaaatsaagtaattacttcccaaactgaacttgtgttgcaaacctctgcccttgtcatctcccaaatatttgtccttctttattgactgggtatagcaacagctcc

SEQ ID NO: 110450 - DNA, 201 bp, Bos taurus
aggctttagcatagtcagtgaagcagaagtagatgtttctatggaactctgttggttgtgtccctagccacagcctatttggttagagcttagcatttttwatcatatatgaacaagaatacttgaatcgtgtttgtttgtatatttttttagtgacccgagagatggtcaaatactggaaacccagtagttgaaccttgg

SEQ ID NO: 110451 - DNA, 201 bp, Bos taurus
ccaaacctaaaacatccttttatcacccctctctatcaaaatctttttatcttttttatggaagtttagaagtaacagtaacactatgacttctttcataygcatccttttaaaaggcttaaaaaatatacttagggatacatgagagaggacaaaagagaaggaaacatagggaaatatagctgatacaatcatacaata

SEQ ID NO: 110452 - DNA, 201 bp, Bos taurus
ggccagcaaagtaatttttcaaaaatgtaaataaggtcattttgctctcccgtttaaattctccagtggcttggtgctgaacttgggataaatttaatacyccttatcatgacttatgaggccttacatgatctaaccttgcatgcctagagattttgcttctcattgtaccatcctctccttcatccattaaaatctaca

SEQ ID NO: 110453 - DNA, 201 bp, Bos taurus
ttgcaggtggattctttatagactgactcaccagggaagctgaatgatttgcagatgctagtaaaaattaaaactgagtcacactattttcaatttgcagrggggatcctataactggcagctaagttaaaacaagaaagtctctaggttctatttttatttctctctaggtctgtatcttgctactaaacctgtgatgtt

SEQ ID NO: 110454 - DNA, 201 bp, Bos taurus; identical to SEQ ID NO: 29451

SEQ ID NO: 110455 - DNA, 201 bp, Bos taurus; identical to SEQ ID NO: 29452

SEQ ID NO: 110456 - DNA, 201 bp, Bos taurus
gctcctgggcaggatagaatccgtcagtgagaccagtgggccacctccttaaaagaatatctcaagttcatcatttagccctggccaacatacttttccartttgacctccccttccttatttttctcctttatatccattacagtctagtgaaactacccatttttgtggcccacaaacccatcctgtgtatccacatct

SEQ ID NO: 110457 - DNA, 201 bp, Bos taurus; identical to SEQ ID NO: 29453

SEQ ID NO: 110458 - DNA, 201 bp, Bos taurus; identical to SEQ ID NO: 29454

SEQ ID NO: 110459 - DNA, 201 bp, Bos taurus
gatttttaaagctacatatattttcaaatattggagttttgtgcttatgtttctatgtctctcacctctcttctaaatctctgccaactgctctgcctcaytgagtttttctattcatgctagatagtaaaaaaatcgacagcaaagaagcaaagacaccaatcagaaaggacttcagtcacagccctgaagggatctctg

SEQ ID NO: 110460 - DNA, 201 bp, Bos taurus
attcagaattgaaggagagatcaaggctgtaccagctaagcaaaaactaaaggatttcatcaccactaaactggtcctgcaagaaatattaaagggatttmtttaagttcaaaggaaatgacattagttaatatgaaaatatatgaaagaaaaaaaataccttattggaaaaggtaaatatatagcaaagttcataaaata

SEQ ID NO: 110461 - DNA, 201 bp, Bos taurus
tttcaaatattttctcacatcattggccatcatgtttttatcaaacctgttttccccccttagaatatattgattggaatggaattattgggtcaaaatgwgattactttaaggccttcaatacatactgacaaatcatcctacaaaacactagtatcaatgttatcaatgtatattttcaagactatcttaaaattctgg

SEQ ID NO: 110462 - DNA, 201 bp, Bos taurus
ctgataatgagattccaggtagcaagactcctgcatgagtttgtaaatctggagcattcttcagtctcaaagtagagaagattaagaaatacaagacaaaratgccatgagagcacagactaagtgatgcatcaagactggagttttattagaagaaatagacataatattaacttgggagaaatgcaaacatattgatga

SEQ ID NO: 110463 - DNA, 201 bp, Bos taurus
agtgtgtgtctgtgtgtgagtatgtgtctgctgtgtgtatacatgaaaatagattatgaaagattaccacatgcaattatggaggcccaggagtcccaagmtctgcagtcagtgagttgaagacccaggagagttgattacatatccccagtctgggtccaaaggcctaagaaccatgagagctgatgctgcaaattccaa

SEQ ID NO: 110464 - DNA, 201 bp, Bos taurus
ttgtactttaatatgccctaccgatggttgaggcagcaaacgtttcagtgctgctccagaaaaatttagcacaagctaaagttcatcatcagattgtttcyttatattagaaaaataccataaaaatgttgaattttggcttacctttttaacaagatatggacatttaaggataaaataaagcatttattttaaaacaac

SEQ ID NO: 110465 - DNA, 201 bp, Bos taurus
cacatgctaaatattgttctgatgaaagatccatttattatactggacatgctttcataaacatcctactttcttttttcacatgaaatcaaaggttacawggtaataattatgcatcagaatagatgctttcaaaataggcctctttctacttatttgtcaagtggtaaatttttcttttattatgtgtatttaatatgg

SEQ ID NO: 110466 - DNA, 201 bp, Bos taurus
gaatagcagaggagtgggagtgggggaaaggtgaagaaaaatcagaattaacctttccttgttgtggtgtacatcggcagatagaagagagcagaacagayattaaacttactgccagaaagaaatatttcaaggagactagagagtcattttgtgctcataaatggattaaagaatcatcacaaatactaggtaaaaagt

SEQ ID NO: 110467 - DNA, 201 bp, Bos taurus; identical to SEQ ID NO: 29457

SEQ ID NO: 110468 - DNA, 201 bp, Bos taurus
tgcagatgtagaaaatggacttgtggacacagtgggggagagagagagtgggatgaagggagaaagtagcctcagcgtatttacaccatcaggcatgagaygcatagctggtgagaagttgctgtagagcacatggagcccagtgtggcactctctgatgacctagagggatgggaaggggcatggcttgggaggcttggg

SEQ ID NO: 110469 - DNA, 201 bp, Bos taurus
acaatctacctcttttaattgctactttcttttgaatgaacttcctcttggctcaatgatctaaataaagttttagtagaagaacattaggatgtgtataraaaaggaagaatgggcagtcatatcaagaaagtatggagaatacatgtatacatcttatatcaaagtgtattttgcctcactggaaaacctcctaattga

SEQ ID NO: 110470 - DNA, 201 bp, Bos taurus
gggagagactgactgggggaaactgcctcttgttctgatgggtgggccatgctcagtaattctttaatccaattttctgttgatgggctgggctgagttcrcgccctgttgtttggatgaggccaaactgttgacccacacctcaccagacactcctggacactcacaggcaagtctggctcagtcttccactggcctcca

SEQ ID NO: 110471 - DNA, 201 bp, Bos taurus
ttggcctctctctagagccctaaaggattcttctggtaagcacctggcatgaacagaagcttcatctcactggcaatggtcctaatttaaactgattttcyaggcctcactctcttgttctttatgggtttgcatggtacagacagggccccaggaggagaggtggttctgtgaagcctcatactcctttagagtttaaga

SEQ ID NO: 110472 - DNA, 201 bp, Bos taurus; identical to SEQ ID NO: 29463

SEQ ID NO: 110473 - DNA, 201 bp, Bos taurus; identical to SEQ ID NO: 29464

SEQ ID NO: 110474 - DNA, 201 bp, Bos taurus
aattttgcatgagctcaataataattgttgtttgaagccataacaatttctctcacttgtataatggaagaaaagtttttttttttctcttaatggaaacratatagcctggaccctgtaaaggtgcacacaaatattgtgaatactacccacatgctgacagattaacagttcttttaaaagttaccattaaggatccaa

SEQ ID NO: 110475 - DNA, 201 bp, Bos taurus
taagtgtttctccctatctcatctatattatttccaaaatcacttgcttctatcttggaatatgcatatttttgacattagcaaaaactgctttagaggtrgattgctactaatatcatatattttaatactgtcaatgtgcttgcttatttttcatgtaccatctgtaaacctatttttgtccaactctgtatttatgct

SEQ ID NO: 110476 - DNA, 201 bp, Bos taurus
agttggctgtgtcagactaacaagccagaaccaaggagaaagcatgtctgctggagagacaagcaggacatagggacaggggaggaggaccagacaccaayaggtaatagtaactaccctcactgtttcatcaaccacagcagtagagtctttagagagtaggcaacagtttggtgagaaattagcaccaaggaattccaa

SEQ ID NO: 110477 - DNA, 201 bp, Bos taurus; identical to SEQ ID NO: 29467

SEQ ID NO: 110478 - DNA, 201 bp, Bos taurus; identical to SEQ ID NO: 69182

SEQ ID NO: 110479 - DNA, 201 bp, Bos taurus; identical to SEQ ID NO: 29468

SEQ ID NO: 110480 - DNA, 201 bp, Bos taurus; identical to SEQ ID NO: 69184

SEQ ID NO: 110481 - DNA, 201 bp, Bos taurus; identical to SEQ ID NO: 29471

SEQ ID NO: 110482 - DNA, 201 bp, Bos taurus; identical to SEQ ID NO: 29472

SEQ ID NO: 110483 - DNA, 201 bp, Bos taurus
gatccgaacaaggaagccacatataattgaggaaaaggactgtaggcttaagaagtaaagttggactggatagtgacagactagtatcaggcattcttacrtatgtctagccaggagggggatttttttttttttttttaagtgatgctttctcctcacaactgaataacaaaaagacattctgcttcttgacaagtcgaa

SEQ ID NO: 110484 - DNA, 201 bp, Bos taurus; identical to SEQ ID NO: 29475

SEQ ID NO: 110485 - DNA, 201 bp, Bos taurus; identical to SEQ ID NO: 29476

SEQ ID NO: 110486 - DNA, 201 bp, Bos taurus; identical to SEQ ID NO: 29477

SEQ ID NO: 110487 - DNA, 201 bp, Bos taurus; identical to SEQ ID NO: 29478

SEQ ID NO: 110488 - DNA, 201 bp, Bos taurus; identical to SEQ ID NO: 29479

SEQ ID NO: 110489 - DNA, 201 bp, Bos taurus; identical to SEQ ID NO: 29480

SEQ ID NO: 110490 - DNA, 201 bp, Bos taurus; identical to SEQ ID NO: 29481

SEQ ID NO: 110491 - DNA, 201 bp, Bos taurus; identical to SEQ ID NO: 29483

SEQ ID NO: 110492 - DNA, 201 bp, Bos taurus; identical to SEQ ID NO: 29484

SEQ ID NO: 110493 - DNA, 201 bp, Bos taurus; identical to SEQ ID NO: 29485

SEQ ID NO: 110494 - DNA, 201 bp, Bos taurus
gtttattgtgagggtactttgtgggcataggtggattggaccatcagccctatggccaagccctgtgggaccccaggaatagttgctcaatcaggcctcaragggagaggagggataagggtttgtgagttgtcagtcccagctgaggtgttctgcagttggagggcctcagctctttgaatctgttatttatccttcaat

SEQ ID NO: 110495 - DNA, 201 bp, Bos taurus
gactcagaaaatcattctgttctccaaagagaacctataatttatacgactgtgattatcccactggtcagggcctaggtaacattcagcattccattccrtggcactctgacaacactggagacaggagctgtgctcagtttttttaaatacatgtgtttaaagcagatagtgactcaaaaatgaaacagggtaaaaaaa

SEQ ID NO: 110496 - DNA, 201 bp, Bos taurus; identical to SEQ ID NO: 69194

SEQ ID NO: 110497 - DNA, 201 bp, Bos taurus; identical to SEQ ID NO: 69195

SEQ ID NO: 110498 - DNA, 201 bp, Bos taurus; identical to SEQ ID NO: 69196

SEQ ID NO: 110499 - DNA, 201 bp, Bos taurus
cagagttcctcatttgttccttcattactgtcttgataaaggataactatcaaaacacaacctagacgctaggtctcactgccaccagctgggcctgttamtggtacctatccacctttctacctccactggtgcctgctccaacgcatcacacacttgctaactagacacttccttcctggccaaataccacttatttct

SEQ ID NO: 110500 - DNA, 201 bp, Bos taurus; identical to SEQ ID NO: 29489

SEQ ID NO: 110501 - DNA, 201 bp, Bos taurus; identical to SEQ ID NO: 29490

SEQ ID NO: 110502 - DNA, 201 bp, Bos taurus; identical to SEQ ID NO: 29491

SEQ ID NO: 110503 - DNA, 201 bp, Bos taurus; identical to SEQ ID NO: 29492

SEQ ID NO: 110504 - DNA, 201 bp, Bos taurus; identical to SEQ ID NO: 29493

SEQ ID NO: 110505 - DNA, 201 bp, Bos taurus; identical to SEQ ID NO: 29494

SEQ ID NO: 110506 - DNA, 201 bp, Bos taurus; identical to SEQ ID NO: 29495

SEQ ID NO: 110507 - DNA, 201 bp, Bos taurus; identical to SEQ ID NO: 29496

SEQ ID NO: 110508 - DNA, 201 bp, Bos taurus; identical to SEQ ID NO: 29497

SEQ ID NO: 110509 - DNA, 201 bp, Bos taurus; identical to SEQ ID NO: 29499

SEQ ID NO: 110510 - DNA, 201 bp, Bos taurus; identical to SEQ ID NO: 29500

SEQ ID NO: 110511 - DNA, 201 bp, Bos taurus; identical to SEQ ID NO: 29501

SEQ ID NO: 110512 - DNA, 201 bp, Bos taurus; identical to SEQ ID NO: 29502

SEQ ID NO: 110513 - DNA, 201 bp, Bos taurus; identical to SEQ ID NO: 29503

SEQ ID NO: 110514 - DNA, 201 bp, Bos taurus; identical to SEQ ID NO: 29504

SEQ ID NO: 110515 - DNA, 201 bp, Bos taurus
gttaatttctactgtacaataaagtgaatcagctatatgtgtgtatatgtatatcccctccctatggagcctccttccccaccatcccactcctctaggtyatcgcggatcatccagttaaattccctgtgctatacagcagcttctaactatctatttcacacatgatagtgtatatatgtcaatgctactcaatttgtc

SEQ ID NO: 110516 - DNA, 201 bp, Bos taurus
ggtcaggtactttgtctccccaggacttaagtcaacagctatttctcaagtggagtgtatgtttttattgcacagagaatgactgtgctccaaaaccacayggaccatcctctgtgaaaatgattctcctgttggggtttgccacaagatcaatacggtatctggagctttcactgacgctgtgcatatttcctcttttgt

SEQ ID NO: 110517 - DNA, 201 bp, Bos taurus; identical to SEQ ID NO: 29507

SEQ ID NO: 110518 - DNA, 201 bp, Bos taurus
gccttagaaagtagaatcataagttagccgtaattttcatggaacttaacaaccttagaaaacactcttttaatgtcttttctcgtttccccctattcttytctatagcttctgtatttttatactagaattctaattttgtcctttttgaataaccattttataataattatatctccctcttcccatttgtaaaatctc

SEQ ID NO: 110519 - DNA, 201 bp, Bos taurus
tcaacagaataggaattatattacagaataaataaatattttttaaaatatcaataaatatctagtcatcaataaaatatgaaaggcatagaaaatttcaragtgacatcagtaaaataatggaataggaggttctagtcctcaactctccacaaaaatactgatttcgataattactcacaaacaagagttactttatgg

SEQ ID NO: 110520 - DNA, 201 bp, Bos taurus
gataagagaaagattggagctaacctataccatgctttctgtttcaacttgtaagtttttaaatctgtattcatgatagtttaatagtctgtaaacatatrtcacatcataaatttgtgttggaatgcacagggtaaatactttacttgaaaatacgttatttgaatttaatgcacgtctttcaatttcagggagtagaaa

SEQ ID NO: 110521 - DNA, 201 bp, Bos taurus
tttacagccgacagaattacatgaagctcattgttgctgcagatgataatcagatggcacaaggatctctgttttgggatgatggagagactattggtaartcttccatttaggagtgttgggggagtgtgtaatttcctcagttctgtctcaccacagcaaaaatttgaagcaatggacagaccagtgttacagcctggt

SEQ ID NO: 110522 - DNA, 201 bp, Bos taurus; identical to SEQ ID NO: 29510

SEQ ID NO: 110523 - DNA, 201 bp, Bos taurus; identical to SEQ ID NO: 69229

SEQ ID NO: 110524 - DNA, 201 bp, Bos taurus; identical to SEQ ID NO: 69230

SEQ ID NO: 110525 - DNA, 201 bp, Bos taurus; identical to SEQ ID NO: 69231

SEQ ID NO: 110526 - DNA, 201 bp, Bos taurus; identical to SEQ ID NO: 69232

SEQ ID NO: 110527 - DNA, 201 bp, Bos taurus; identical to SEQ ID NO: 69233

SEQ ID NO: 110528 - DNA, 201 bp, Bos taurus; identical to SEQ ID NO: 69235

SEQ ID NO: 110529 - DNA, 201 bp, Bos taurus
tgggtttaaaccatgcaatcttcattcctgaattgaaatgaaaatggagcactgcaatctgcagggaagtgaaggaatgctcatagttcattaaataatgygagtagtaatgaggtttacacaaatcaaacagtgtgttaggtaattgtaatgttgctttgtggtgaaccacctgtcaggaagcacttctagccgaaggct

SEQ ID NO: 110530 - DNA, 201 bp, Bos taurus
tgaaaaatattaagaaagagaactggagagaaaaaggaagaaagactaaaattggggcagcagggactaaaggaaccagggaagcagtcaatactatgacygttttatcaaatgattacacactttgacacttattggagaaacttacctattttaaaacacaatgtgtatagagaaccaactctgccaggcactaaacta

SEQ ID NO: 110531 - DNA, 201 bp, Bos taurus; identical to SEQ ID NO: 29514

SEQ ID NO: 110532 - DNA, 201 bp, Bos taurus
catttctaaaacctcccatttggaattaagcttctctcttaaacattttattaccactttgtattatagaacttactacagtattgtttcacattctgaayatacagtgacttgtgtgtctcttttattgtgtgtgtgtgtgtttgtcacttatttgtgtctgactctttgtgaccccatggactgtagcccgccagactc

SEQ ID NO: 110533 - DNA, 201 bp, Bos taurus
ataaattcttcagtcatatttccaaaaattaatcactctggttaaggttctatccattcttacagccctcattctcaatgcaaagagaaaaaaatgccttmtacttcaagtaaaaacaaagcctatcaagtaagaatgattcagcattctaattacctcttaaacacaattttatataaatcaatctttgttttaatcatt

SEQ ID NO: 110534 - DNA, 201 bp, Bos taurus; identical to SEQ ID NO: 29515

SEQ ID NO: 110535 - DNA, 201 bp, Bos taurus
actatgtaaagaaggtgcatggattttatgtactttgaactttacaaactgaaattatcaaatacttataatttatgagaatgaattactcccttaaaagrcattctccatgtgttaagtttgaaagcttatactcatcctttaagtactaaggcaaatacttttttttttcctaaaaaccattcccaaaatttctatggc

SEQ ID NO: 110536 - DNA, 201 bp, Bos taurus
atgcccatcatgccttgcaaaccattgtatagtaatgttccaaaattcctcttatcatagttcattaatattcctcagtcactacaaattatgaaatatarcattcatttctacatatgaattctccagcagggtcatggctattgtttaattgtctccaattagtagggatgaaaatacttactatacaagaattatagc

SEQ ID NO: 110537 - DNA, 201 bp, Bos taurus; identical to SEQ ID NO: 29523

SEQ ID NO: 110538 - DNA, 201 bp, Bos taurus; identical to SEQ ID NO: 29526

SEQ ID NO: 110539 - DNA, 201 bp, Bos taurus
ttccagatttcaaatctatttttcatgctgcttgtcatatagggctgacatgtgtcacaggatgctgctacatgctgaagtgatgcataaccagacaaaaytttcaaagaataatacattttaaatgcctgtttagtttgatgtactcagaaaattgccccaaaaatcaacatttatgatagtaatataaagagaacaaag

SEQ ID NO: 110540 - DNA, 201 bp, Bos taurus
cctcaaagtcctacctcaaatattcattcatccttttaaagagtttttcaggagcgaaatccagtagctcgtctctggctgaggagaaaatagaaaatgakttgacttgttttactcatactactatctctgtacacttcatcacttaaatcaaaaacttcccatgtgtatttctcaggctaaaatataaaagttgtaggt

SEQ ID NO: 110541 - DNA, 201 bp, Bos taurus
gaaaaaaataggcttcaagcaaaaaaaaaaaaaaaaggcagaaagagcatacgtatgtactcctcttatatccctaagtctacctcacctacatacatgartctaataagaaatacagccttaataagaaatgatggggggggggggaagagatttaaaaagatttatttagcatagtgcttagaaaacaagaatccagaa

SEQ ID NO: 110542 - DNA, 201 bp, Bos taurus
ctctgctttttctgcttcagactagaaagtggtctgtggcctcacaaaggaaaattatttcagcctcccatactttaagacttctgaagtacatgcgtgtrtctacttccatagtttcctgcctacaggtaaatatatgacattaaagagtggctttctatttttatccaagtgatctgtttgagtgtttaaaggtttcct

SEQ ID NO: 110543 - DNA, 201 bp, Bos taurus; identical to SEQ ID NO: 29529

SEQ ID NO: 110544 - DNA, 201 bp, Bos taurus; identical to SEQ ID NO: 29530

SEQ ID NO: 110545 - DNA, 201 bp, Bos taurus; identical to SEQ ID NO: 29531

SEQ ID NO: 110546 - DNA, 201 bp, Bos taurus; identical to SEQ ID NO: 29532

SEQ ID NO: 110547 - DNA, 201 bp, Bos taurus; identical to SEQ ID NO: 29534

SEQ ID NO: 110548 - DNA, 201 bp, Bos taurus; identical to SEQ ID NO: 29535

SEQ ID NO: 110549 - DNA, 201 bp, Bos taurus; identical to SEQ ID NO: 29536

SEQ ID NO: 110550 - DNA, 201 bp, Bos taurus; identical to SEQ ID NO: 29537

SEQ ID NO: 110551 - DNA, 201 bp, Bos taurus; identical to SEQ ID NO: 29538

SEQ ID NO: 110552 - DNA, 201 bp, Bos taurus; identical to SEQ ID NO: 29539

SEQ ID NO: 110553 - DNA, 201 bp, Bos taurus; identical to SEQ ID NO: 29540

SEQ ID NO: 110554 - DNA, 201 bp, Bos taurus; identical to SEQ ID NO: 29541

SEQ ID NO: 110555 - DNA, 201 bp, Bos taurus; identical to SEQ ID NO: 29547

SEQ ID NO: 110556 - DNA, 201 bp, Bos taurus; identical to SEQ ID NO: 29550

SEQ ID NO: 110557 - DNA, 201 bp, Bos taurus; identical to SEQ ID NO: 29551

SEQ ID NO: 110558 - DNA, 201 bp, Bos taurus; identical to SEQ ID NO: 29554

SEQ ID NO: 110559 - DNA, 201 bp, Bos taurus
aaataccatacaattagtttccagagcttcactcactatctctgtcagttttaggaactgcctgtcactatatccctccagtaccagtggatgaggctatrtgcagcataaaaccatgaaagagccagaatttgctagaataatcctggtcttaaatgttccagggctaaagctcacagctgactattagcaaactatgaa

SEQ ID NO: 110560 - DNA, 201 bp, Bos taurus; identical to SEQ ID NO: 29555

SEQ ID NO: 110561 - DNA, 201 bp, Bos taurus
caaacgatcttccccactcattcagcacgagctctgtcccaaagtaccacaaccgtgccacccacagttgagttgtttcagcttccccagggccccagacragagtgtgcatggctgtggatcaggtcccaggtctgttatcatgctggagagacttcacaccaattaagagaactgatggcccctagagcagagggaggg

SEQ ID NO: 110562 - DNA, 201 bp, Bos taurus; identical to SEQ ID NO: 29557

SEQ ID NO: 110563 - DNA, 201 bp, Bos taurus
ttgaatgatagagtgaatgtgagtagtaaccctgatgttttcttgtgctaagctgtgactacagacatttacatatatatagaaacattcaagcttaaaaktgtggccttgcactgtgcagataaaaaaacaaaaaccaacatgggcttctgtgtccctgctgggatgagtgactgagatctggggcaggtgctctgagcc

SEQ ID NO: 110564 - DNA, 201 bp, Bos taurus; identical to SEQ ID NO: 69272

SEQ ID NO: 110565 - DNA, 201 bp, Bos taurus
cagtgcaaggggcctgggtttgctccctggccagaggactgatcccatgtgctgcaactaaaagttgcaagccacaacaaagaccaaagatcctgagtgcyggaactaagacccggccgtcacagcgacagtgtagtgacttcacaacctaagtgtaagagtgagcgaggaggaaggcagaatagaaaatcgactgtgtat

SEQ ID NO: 110566 - DNA, 201 bp, Bos taurus
ctgaaaaaaaaaaaggggtggggaagggagaagcaaatcgcaaacagtcagaaaataattcttattatcctaaagaatggctcttcacagccttcagaatytaatttcttccttcctggcaaggtccctggttgtctttcatttcggaaacttcctttcaaaatatacatacccagtggtctagggctgggaaaaggcgca

SEQ ID NO: 110567 - DNA, 201 bp, Bos taurus; identical to SEQ ID NO: 69274

SEQ ID NO: 110568 - DNA, 201 bp, Bos taurus; identical to SEQ ID NO: 69277

SEQ ID NO: 110569 - DNA, 201 bp, Bos taurus
tgaagacacagttaaaactattggataagttcatataaagaatattaatgaattcaatataggattaatggtgagttcttttttcttcaagaatacctagyaacctgataattcaaggcctctcagcactttcttgtcttcatctgccaagatgtgcaggttgttgaaagtggatgtgtgcttatcttgatgtgaatgtgt

SEQ ID NO: 110570 - DNA, 201 bp, Bos taurus; identical to SEQ ID NO: 29558

SEQ ID NO: 110571 - DNA, 201 bp, Bos taurus
gaaggaagtggaaagtgacaattgcaggaaggacagggcatgattgcaaaagcaaaattcttgaggaggcaagacaatatgagtttctgtgatgccgtgcmcagtggagaagttgtcccctatgggcacagagactgttggaatgatgtaaccagtgggaagatagagccagatagaactagacgtaggaagataaggcag

SEQ ID NO: 110572 - DNA, 201 bp, Bos taurus; identical to SEQ ID NO: 69285

SEQ ID NO: 110573 - DNA, 201 bp, Bos taurus; identical to SEQ ID NO: 29570

SEQ ID NO: 110574 - DNA, 201 bp, Bos taurus
taatcaagacccggcagactcggaaaaactcttctctcttacctatctaaaaaaacttagatagggggcctggcccagaaaaagagttagtaccagagatwtttttttacctggaagacttacctgcatgacaggacaaacatttgcttttcttatcttcctttgaattactctcctccctcttgaagcccaagcccctat

SEQ ID NO: 110575 - DNA, 201 bp, Bos taurus; identical to SEQ ID NO: 29571

SEQ ID NO: 110576 - DNA, 201 bp, Bos taurus; identical to SEQ ID NO: 69290

SEQ ID NO: 110577 - DNA, 201 bp, Bos taurus; identical to SEQ ID NO: 29573

SEQ ID NO: 110578 - DNA, 201 bp, Bos taurus
ttgtgataacaatgtactagtaaaaggttttattggcaaccattccatctgaaccaatctaccttttcattgtcttcttctaggcacttgtgcatgagtgytcagtcactaaatcatgtccaactctgtgactccatggattgtagcctgccaggcttctctgtccatggaattttccaggtaagaatactggagtaggtt

SEQ ID NO: 110579 - DNA, 201 bp, Bos taurus
atatgagacaaggctgtgccaaagaggccactggggagagtacaaaagtagatggagctgagtgtacacctacagaatgatttcatagacatgaacaggarcccctaacaaaataatacctctagtactcttgcttcctgccagcaaccttagctggggtaaaagcatgtgtcctgtagtatgaaggtaaccagtctgagc

SEQ ID NO: 110580 - DNA, 201 bp, Bos taurus; identical to SEQ ID NO: 29575

SEQ ID NO: 110581 - DNA, 201 bp, Bos taurus
aaaaacaaagcttccaaaatttaagacatttggctagattttttgatgttcttttgagcttaaaaatttttataatcaaattaggtttactatcccatctygttctttactgctttgaggacctctagcctttccttttacaatttctgatgtcctaatatttgcattgatgtaagttctctgttgaacatctagaaggtt

SEQ ID NO: 110582 - DNA, 201 bp, Bos taurus
ttcattgcagggctgctgtaggagggcctgagcatcgtgcgtcggttcctccatcactgagggcagcagggctctgtgagacaggcctctcctcatctggkgacatccaactgacttttttgcgtcttcatggctaataaatggttagtgacagggaggcctggcgtgctgcgattcatggggttgcaaagagtcagatat

SEQ ID NO: 110583 - DNA, 201 bp, Bos taurus; identical to SEQ ID NO: 29576

SEQ ID NO: 110584 - DNA, 201 bp, Bos taurus
aaaggaaactctaagaaggccagcccacgccatgctccatgtgctctcctgccctgaggtcctcattcatgtgctcctttctctgtttaggggtgtgtacrtgtcccctccacccagtggcccttgctgggcttaacagacctgagaaaactattactctctcaggcaatcatttgtttgactaaaacagtcaagctggag

SEQ ID NO: 110585 - DNA, 201 bp, Bos taurus
atgcaactccaacatatgcaaacaatgcttcccatgtccaattctaaaataattttaacttcttagttgacttactatttccatagacttttcatcaatayaatgttaatgtaatcagataataggtactcactcaaattgagaaccttaaattatttagtgatttggtaggcatagaaaatgacacataattgctttgaa

SEQ ID NO: 110586 - DNA, 201 bp, Bos taurus; identical to SEQ ID NO: 29582

SEQ ID NO: 110587 - DNA, 201 bp, Bos taurus; identical to SEQ ID NO: 29583

SEQ ID NO: 110588 - DNA, 201 bp, Bos taurus; identical to SEQ ID NO: 69304

SEQ ID NO: 110589 - DNA, 201 bp, Bos taurus; identical to SEQ ID NO: 69306

SEQ ID NO: 110590 - DNA, 201 bp, Bos taurus
tagacatagatgatggaggggagtcaattccgtacatcattagaacatatccaatagaaaaaataactcagaagttctagtatcccaatacaaatatacaygatgatcagagatatagaagcctgtagccaacattcaactgaaaggagtatttagtatgatagctcctctaacagtgatagaaggagggcattttcagat

SEQ ID NO: 110591 - DNA, 201 bp, Bos taurus
ttgtcatctactagacaacccagagctggtgctggcgtagcatttcactgcgaagaaaaccgccacttacagaaagaagtacatggaaactcatcattatrtattctaaacttttatgatgcttttcttctgagcttttaaaattctgctgcataggtatcattttcctgtctatgaagatagaggaactgagccataggt

SEQ ID NO: 110592 - DNA, 201 bp, Bos taurus; identical to SEQ ID NO: 29584

SEQ ID NO: 110593 - DNA, 201 bp, Bos taurus; identical to SEQ ID NO: 69308

SEQ ID NO: 110594 - DNA, 201 bp, Bos taurus; identical to SEQ ID NO: 69309

SEQ ID NO: 110595 - DNA, 201 bp, Bos taurus; identical to SEQ ID NO: 69310

SEQ ID NO: 110596 - DNA, 201 bp, Bos taurus; identical to SEQ ID NO: 69311

SEQ ID NO: 110597 - DNA, 201 bp, Bos taurus; identical to SEQ ID NO: 29587

SEQ ID NO: 110598 - DNA, 201 bp, Bos taurus; identical to SEQ ID NO: 29588

SEQ ID NO: 110599 - DNA, 201 bp, Bos taurus; identical to SEQ ID NO: 29589

SEQ ID NO: 110600 - DNA, 201 bp, Bos taurus; identical to SEQ ID NO: 29590

SEQ ID NO: 110601 - DNA, 201 bp, Bos taurus; identical to SEQ ID NO: 69317

SEQ ID NO: 110602 - DNA, 201 bp, Bos taurus; identical to SEQ ID NO: 29594

SEQ ID NO: 110603 - DNA, 201 bp, Bos taurus; identical to SEQ ID NO: 69323

SEQ ID NO: 110604 - DNA, 201 bp, Bos taurus; identical to SEQ ID NO: 69324

SEQ ID NO: 110605 - DNA, 201 bp, Bos taurus
caaaatattttgctatactattagaaaagcttacccctaccacttcttaggataggtgtggcacaaatttaatgtcatgtttataaatgaaaatcaatgcrtcaaatgcaaattacagttaaattatatgtttgcagataagcgaatctttctttcctaagaccctttcttgtggccttttctaatgaaaaaaattcagaa

SEQ ID NO: 110606 - DNA, 201 bp, Bos taurus
tttcgctttatggtggtgcctggttatctaacttagcaatcatctaaattatccattatttgcatgtgcattattaaaattataaaatcaatatacataamaaattctcctggaagactgtgaacacctacaaatagatatgaagatattagtttgaaaaatactgaccagctcctacacaatgatttcacaagtgaaaaa

SEQ ID NO: 110607 - DNA, 201 bp, Bos taurus; identical to SEQ ID NO: 29598

SEQ ID NO: 110608 - DNA, 201 bp, Bos taurus; identical to SEQ ID NO: 29599

SEQ ID NO: 110609 - DNA, 201 bp, Bos taurus; identical to SEQ ID NO: 29601

SEQ ID NO: 110610 - DNA, 201 bp, Bos taurus; identical to SEQ ID NO: 29602

SEQ ID NO: 110611 - DNA, 201 bp, Bos taurus; identical to SEQ ID NO: 29603

SEQ ID NO: 110612 - DNA, 201 bp, Bos taurus; identical to SEQ ID NO: 69330

SEQ ID NO: 110613 - DNA, 201 bp, Bos taurus; identical to SEQ ID NO: 69331

SEQ ID NO: 110614 - DNA, 201 bp, Bos taurus
tttggcttccacgatttgacactgagaatgttttgtctcagaatgtctgaataagatgtcatcagaattacagtcacattaattaattttcaccttgaacraactagtacatgttttccagggtaaaagccataatactaatctaaatccttgatcaattttctatagggcaaatatttccatttttgttttatactccca

SEQ ID NO: 110615 - DNA, 201 bp, Bos taurus; identical to SEQ ID NO: 69332

SEQ ID NO: 110616 - DNA, 201 bp, Bos taurus
tttgctgctttgcagaaagaaacaaaaacccatagagttccttcaacaacatatatttactttacaaatatcaaacctaagtaccacacctgtgctctgarggctttcttcgtgtgcaatgactttctgtttcaatattgaatcatagagtaaacattttgaagacattgtaaagggcgatagagctggacatatccaata

SEQ ID NO: 110617 - DNA, 201 bp, Bos taurus
atttaagtggtaaatccattaagaaaagcaaaaaaagtaaataccttaggagtcagaattttctttagtgaagaatgtaagagttgtgattagaaaagaaycatgggtggggattttctgaggtgtttatagtatattatttctttttacttttcctttaaaaatcattcttattgcggtttaactcacatttaatgaaac

SEQ ID NO: 110618 - DNA, 201 bp, Bos taurus
gtgcctgatggggtattggaaggatagagatgtcaggaaggccagtaagggtataatacagtggaagagaaggggagttggtgggaagtgatgttagagaygggcagggtcctggtgacaggggccttgtaggccaaagtgaagcattagaatttcagttgcagcaggaagctattagaacaagctaagctattgtttaga

SEQ ID NO: 110619 - DNA, 201 bp, Bos taurus
catggggtcatgaagagtcagacaagacttggtgactgatcaaaaaccccttgtctgcagtctctgtgctttgttattctttctgatgttctttgcttttkggggccagaatgagttgggagcagtcttccttttgaatctgggactcaccttttttttttttttttccccacggagcatctaatgagactcttccttttc

SEQ ID NO: 110620 - DNA, 201 bp, Bos taurus
aatactccaaagaaattttgcttttctgtcatacaaatatggtttgcattaaccttatgatacaagttattaatacatgtcagctttctttccccactttwgtgggaagatatattttgaacaatttgtctgcagattccattaaatggatagagctaggtatttacttagaccagtggttttcagcatagactgccattg

SEQ ID NO: 110621 - DNA, 201 bp, Bos taurus; identical to SEQ ID NO: 69338

SEQ ID NO: 110622 - DNA, 201 bp, Bos taurus; identical to SEQ ID NO: 69339

SEQ ID NO: 110623 - DNA, 201 bp, Bos taurus
tccattatatgcttttaaaagttagtaacactttcctcagacttgtgccaaattggccactaaagtaataacataagaatggatgaaattattttaatackttctgaaatactcctcaatgtaactcagttcagcatttcattcttgcagcagttaactggctatatcaggtactgcttcttttattagtatttatgtttt

SEQ ID NO: 110624 - DNA, 201 bp, Bos taurus
ttacaaagcaaaaaaaaaaaaaagtttcactgaaagtcttgggaaattctagttcaaggaaacccccaagtacagcatccagagattcacaataatattgrgatcttgatctcatattctccaaaatttgtctgtgtaacccagatctagtcctatagttctctccatgttgcttcagatatttgagctctggtggtagta

SEQ ID NO: 110625 - DNA, 201 bp, Bos taurus
ataagattacacttagaatttctaattagaaaccacaacttaccttgcatcatgaaaaggaactaaaacagaatcctaatgtgaatggttgaattaaagaktgacagaacaaaaagctcaacactttgcccatttgatgggaagagccgactcactggaaaagaccctgatgctgggaaagactgagggcaggaggagaag

SEQ ID NO: 110626 - DNA, 201 bp, Bos taurus; identical to SEQ ID NO: 69343

SEQ ID NO: 110627 - DNA, 201 bp, Bos taurus; identical to SEQ ID NO: 29608

SEQ ID NO: 110628 - DNA, 201 bp, Bos taurus
gtatgtgctcttgcacatactacatttctggaaataatgctgaagtcagtagtttacaagtctgagaatccaggcttgtagtaatatatgctgactggccyggaagtagtttataaaataatatttgttttattgaaatcaaatttggttgtcagcgttttatcatttttatctaattagtttttaataacttaacttatc

SEQ ID NO: 110629 - DNA, 201 bp, Bos taurus
ttatataacactgaatattaaatttaacatatattgttgatggcctcatatacctattgctgtgagttgaattgtgtctccccaaaagatatgttgatcckaaacccagtacttgtaaatgtggccttatttagaaatagggtatttctattaatagatataatcaagtgacaaaaacggtccactggagaagggaatggc

SEQ ID NO: 110630 - DNA, 201 bp, Bos taurus; identical to SEQ ID NO: 69347

SEQ ID NO: 110631 - DNA, 201 bp, Bos taurus; identical to SEQ ID NO: 69348

SEQ ID NO: 110632 - DNA, 201 bp, Bos taurus; identical to SEQ ID NO: 29609

SEQ ID NO: 110633 - DNA, 201 bp, Bos taurus; identical to SEQ ID NO: 69349

SEQ ID NO: 110634 - DNA, 201 bp, Bos taurus; identical to SEQ ID NO: 69350

SEQ ID NO: 110635 - DNA, 201 bp, Bos taurus
tactgttacgctgcattgtaggtttcatttagtcacacgatgaaataatttaaggaaagaatttgggaattatgatgctactttctgctatgtttaggcaytccttttttcccccacagtgttaataataaagataataaaaaagtgtttaattttgaagcttgtggagatataactactgaaagatcttgagctcaaaat

SEQ ID NO: 110636 - DNA, 201 bp, Bos taurus
ttaattcacaccaaaataaaaaggacactgtaagtacaattttcagtttccatctacaagccacactgctctagagaaaaatgtcagcaactggcacactyattgatggtaggaatataaatttctggagaaaatttggtaaagtgtcaaaagtctttttttttaaattacatacgttttgatagagcaattttacttctg

SEQ ID NO: 110637 - DNA, 201 bp, Bos taurus
gaataaccactgctactggagatgactggaccaggatctagccctggaaaggaaagggctagactgcttccaatgttggtctagggctcaatctcaggtcyagggctgttttgtaccctaggggagatttgagttcaaggcaggaaaacctggcacagccaacacatgtagaatcccaatctatgggaagatcagtcagga

SEQ ID NO: 110638 - DNA, 201 bp, Bos taurus
gaaaatgaaaaccttgtctctgtttaagtaatgattcagtaagtcattgtggtcaaacaagttctcaaaattgggggataaatgggggaatggaaagacaycccccttagtaatctctagagggtcagttaattttccaaataagaatgcatttaaattcactttagatataatttcctgaataagtaaagttttaacctt

SEQ ID NO: 110639 - DNA, 201 bp, Bos taurus; identical to SEQ ID NO: 69352

SEQ ID NO: 110640 - DNA, 201 bp, Bos taurus; identical to SEQ ID NO: 69353

SEQ ID NO: 110641 - DNA, 201 bp, Bos taurus; identical to SEQ ID NO: 69354

SEQ ID NO: 110642 - DNA, 201 bp, Bos taurus; identical to SEQ ID NO: 69355

SEQ ID NO: 110643 - DNA, 201 bp, Bos taurus; identical to SEQ ID NO: 69356

SEQ ID NO: 110644 - DNA, 201 bp, Bos taurus
gaacaagtgcctaataaatggagtttgcaatccaaagtttacttggccaagccaagtcctctggctacaataccctcttctctctactctatgtatgttgyaaacattttttgtcttctactttagggaaattatgaggacactgttcagttcagttcagttcagtcgctcagtcgtgtccaacactttgcgaccccatga

SEQ ID NO: 110645 - DNA, 201 bp, Bos taurus; identical to SEQ ID NO: 69357

SEQ ID NO: 110646 - DNA, 201 bp, Bos taurus; identical to SEQ ID NO: 69361

SEQ ID NO: 110647 - DNA, 201 bp, Bos taurus; identical to SEQ ID NO: 69362

SEQ ID NO: 110648 - DNA, 201 bp, Bos taurus
tcggaagtggaatggtatgttatcagcaatgagcgatgctgaccactttgaaattcacttcccattagacctggatgtgaccatgaaagccatgatttttrgagcttgcttcctcattgtaagtctgtcacttttgagttatcttgaaagtgttattctttctgatgaggaataatagtacagagtgctgggaagggaata

SEQ ID NO: 110649 - DNA, 201 bp, Bos taurus
tttcctttttcacctttcaggagctccaatcccatcccaaagtctttttcttttttatcctgcccagctacatgaggatctttcttgcagctttggttgtrtaagaggccttataccagttcacagttgcttttgtgtgagaattgttccacatataaatatatttttgatgtgtttgtaaagagaggtgagttccaaatc

SEQ ID NO: 110650 - DNA, 201 bp, Bos taurus
ttcctttctgaaatgtagtcatgcaaattaaacttccatggcaagttccagcatcacatgtgaattgcacacatagatttcagtccagtgaatgtacaaayaactgagtgcattataaatactatgagaatctgtgactttaaaatcttgctattagtgttagaacaagaactatattaattaaacaatcttttgtttttc

SEQ ID NO: 110651 - DNA, 201 bp, Bos taurus; identical to SEQ ID NO: 69365

SEQ ID NO: 110652 - DNA, 201 bp, Bos taurus; identical to SEQ ID NO: 69366

SEQ ID NO: 110653 - DNA, 201 bp, Bos taurus
tgttataacctctagaaagtttgagcactcatcttagatctagaagagatggagagaaaaaacctccatgtcagggcacagtagaacccttgtaccctgayatttacaaaatgtgtgtctgcaatttataccaggggtccttagggctggattaaatattcagattcccaagatacttgtctgcagtctactgtgcacaga

SEQ ID NO: 110654 - DNA, 201 bp, Bos taurus; identical to SEQ ID NO: 69367

SEQ ID NO: 110655 - DNA, 201 bp, Bos taurus; identical to SEQ ID NO: 69368

SEQ ID NO: 110656 - DNA, 201 bp, Bos taurus; identical to SEQ ID NO: 69369

SEQ ID NO: 110657 - DNA, 201 bp, Bos taurus; identical to SEQ ID NO: 69371

SEQ ID NO: 110658 - DNA, 201 bp, Bos taurus
atatatagtagttgtcagatttaaatccaaaaaaaatgaaatttgttttttagtaactaaaaatttcatactcacaaatggagaatttcctcagagtttcyatttattcttgtgattgtccattgtatctctgtcctttgcatcatttatatttgctaaaatagaattttgtctttacaaatgccaccctctcttaagtca

SEQ ID NO: 110659 - DNA, 201 bp, Bos taurus
tccacatgaaaatcatgtcttctttatagcatgtattatcaagaaaataggaagtcctgcctcatgatataatcctattgttcatcattcttgaacttttrtccattgatgaactctacactcaaaactttccttctactctgtttgctcataccctttcaaaatgaacatgccacccaataccagaccttcaaagtgctg

SEQ ID NO: 110660 - DNA, 201 bp, Bos taurus
ttactgaattcattacaatattgcttctgttttacattttggtgggatctcaactccctcaccagggattgaacctgcaccctctgcttaggaatgcacartcttaaacgctggacctctagagaagtcctaatccttatttcttgagtttttatcttcatctagctctttgtagtcctttgcctcttcatctcatgatgt

SEQ ID NO: 110661 - DNA, 201 bp, Bos taurus; identical to SEQ ID NO: 69374

SEQ ID NO: 110662 - DNA, 201 bp, Bos taurus
tgaataattttttaaagtgtttcagagaattgtggcgcacagactctgacatgacctccatatatctctgcctcctggtattcacatctttgtgtgatccsctcctgttttgtgtgggtggaacctgtgactcacttctaaccaacggagcacagcaaaggtgctgcgattatgctgcagaagatttcaacatctgtctta

SEQ ID NO: 110663 - DNA, 201 bp, Bos taurus; identical to SEQ ID NO: 69376

SEQ ID NO: 110664 - DNA, 201 bp, Bos taurus
tgcatgcccaaatctgaggcttgtcaaaaaaacaatgaacacaccactcatcacaagctaacaaggtacagattacaagtagaaacataatattgctgacraaggggcaagaaaggaacaagaacatgtagagatactgtgttaaaggcactgcaaactgaaaatcaaaatctcagaatctagcatttctttggtaaacca

SEQ ID NO: 110665 - DNA, 201 bp, Bos taurus
atcagaaaataactaggatagtgaaacatttaaaatgtttcataataaaggaaaaaggataacttatgactgaacattttcccttcataagcagggtggcraaatcagaactaatgatatgaaaagttgcttttatttagtgaatgactagcacatgactccctgctagttcccttaataatgataaggtaaagaatacta

SEQ ID NO: 110666 - DNA, 201 bp, Bos taurus; identical to SEQ ID NO: 69378

SEQ ID NO: 110667 - DNA, 201 bp, Bos taurus
aaagattttactttgttatgagatattggctatgttgtataatacatccttatatgtagcttattttatataaaatagtttaactcttaaccctctaccaytataccgttaagcttttaacttgatcaagtccttctttatagttactgcttggctttttgtcattctttttgtggttgcttataaattcattttctcaca

SEQ ID NO: 110668 - DNA, 201 bp, Bos taurus
aaagaatcagacatgactgaatgactttcactttctttttattttcactttccccataaatcagcccacacttgcatctacgtaacctggatgggcctctrccagctcagtcaccctttggggtcttcacagtttcaaaatggcatctaacatgccatccctctatggcatcccctcacatgccatgccttgctttcagga

SEQ ID NO: 110669 - DNA, 201 bp, Bos taurus; identical to SEQ ID NO: 69379

SEQ ID NO: 110670 - DNA, 201 bp, Bos taurus
tttgggagatgttgtttctccactggccttcagtctcagagcaaatgcctggacatgcagggacagcacattgtcatgctgatcaccagagacttgccaaytcttggccaaaaaggaggctactaagactggaaaatcaacttggtgggaggcacctggtaggcagcaaactctcttacaccaagcagtgaaaacaagtaa

SEQ ID NO: 110671 - DNA, 201 bp, Bos taurus
ttttgcacatggagatgaatctagctattatagtagattttggtggaatacaataatatttcaatctgacaagcaattgactctgctttttccaaattcartatttcttaaatatagtgccttaacagattaggtttacataagttcaaagtagagttagaaagactttttcacttaaaaaaaaaaaaagattcttcattt

SEQ ID NO: 110672 - DNA, 201 bp, Bos taurus
tttttggctcctggactctaaaagcctactcagcctgttttaatggtagcatctaggtttaccagtttggcagtggccctactatgcttcatctctattayagtatcagggtcctaagaatagcactaaaagctgagctctttatggctactgggaaactttccctctggtaagtttccattatatggtggccaccttccc

SEQ ID NO: 110673 - DNA, 201 bp, Bos taurus
tattagcaactttctccatcaaacttttgatgagaattaatgactgggagaaaaatgacctttcctgggcaactgtccccttatctttccctaaccattcraagtggatttttttaaaagcagtgccttccaatataaacttggcaaagggaagaaagagcccaactatcttgcttagtctatgacaaagaatggttttca

SEQ ID NO: 110674 - DNA, 201 bp, Bos taurus
ttcttgaagtcgtcttcaccttgttcgcccatcctggaaggcatcaaggaagcttggttaagttctaggagccacagactgtaaagcagccaaaggctgtrattcatttgcagttctctctccctcacctcttgcccatcctcctttgccccaccccggtctcaccagttgtggttggagaaaacctttttgttgctcccc

SEQ ID NO: 110675 - DNA, 201 bp, Bos taurus
gaattgaccaagatgtctgagagagagcactcagcacacacaagcatcaggggcaacagaaaaagttaattcattccaatcccatcaccgaggtttgttcycccattggtttcaaatgacaagggcctaattacattgtcatgataaggaaaagctgacacttgaaagctcgggtcctgcttatctgtcaggtcagctctt

SEQ ID NO: 110676 - DNA, 201 bp, Bos taurus
cttctggaggacatttatttgaacataattctggtcactgtaggcccccagcccttgcagatattctagactagaggccccatgtgccaactacaagcttytagcaaaatgtttactttcaagacaaataagacagtagaatgaaaagtggccgttgctgtctaaactctaagattttacctaaactgcaactcttctgat

SEQ ID NO: 110677 - DNA, 201 bp, Bos taurus; identical to SEQ ID NO: 69381

SEQ ID NO: 110678 - DNA, 201 bp, Bos taurus; identical to SEQ ID NO: 69382

SEQ ID NO: 110679 - DNA, 201 bp, Bos taurus; identical to SEQ ID NO: 69383

SEQ ID NO: 110680 - DNA, 201 bp, Bos taurus; identical to SEQ ID NO: 69384

SEQ ID NO: 110681 - DNA, 201 bp, Bos taurus; identical to SEQ ID NO: 69385

SEQ ID NO: 110682 - DNA, 201 bp, Bos taurus; identical to SEQ ID NO: 69388

SEQ ID NO: 110683 - DNA, 201 bp, Bos taurus; identical to SEQ ID NO: 69390

SEQ ID NO: 110684 - DNA, 201 bp, Bos taurus; identical to SEQ ID NO: 69391

SEQ ID NO: 110685 - DNA, 201 bp, Bos taurus; identical to SEQ ID NO: 29618

SEQ ID NO: 110686 - DNA, 201 bp, Bos taurus; identical to SEQ ID NO: 29619

SEQ ID NO: 110687 - DNA, 201 bp, Bos taurus; identical to SEQ ID NO: 29620

SEQ ID NO: 110688 - DNA, 201 bp, Bos taurus; identical to SEQ ID NO: 29622

SEQ ID NO: 110689 - DNA, 201 bp, Bos taurus; identical to SEQ ID NO: 29623

SEQ ID NO: 110690 - DNA, 201 bp, Bos taurus; identical to SEQ ID NO: 29624

SEQ ID NO: 110691 - DNA, 201 bp, Bos taurus; identical to SEQ ID NO: 69394

SEQ ID NO: 110692 - DNA, 201 bp, Bos taurus
ttgtctaatcccttccttcttgtgatggagaaacagaggctcagagaggggaggtgacttgcccaaggtcacacagctggctgccaagctggagtggctamgctaggttttctggctcccagtcccccctccctcttttccaagcacctcccaacaaccagtacccgtatacctggggcattactgcttagccacccacac

SEQ ID NO: 110693 - DNA, 201 bp, Bos taurus; identical to SEQ ID NO: 29625

SEQ ID NO: 110694 - DNA, 201 bp, Bos taurus; identical to SEQ ID NO: 29626

SEQ ID NO: 110695 - DNA, 201 bp, Bos taurus; identical to SEQ ID NO: 69398

SEQ ID NO: 110696 - DNA, 201 bp, Bos taurus; identical to SEQ ID NO: 69399

SEQ ID NO: 110697 - DNA, 201 bp, Bos taurus; identical to SEQ ID NO: 69400

SEQ ID NO: 110698 - DNA, 201 bp, Bos taurus
tcccatctgcttgttacagcagtggggacttccagtcttgctcttctctgcttggttgctttcttcctatacagtgcccttgagggtacatattgtgtccyggccatctcaggttattccaagtaccaggcatggagaaggtgcagaaaaaaggagatgtaaaaaaaaactgttgataaacgaatgaacaaatgggcattt

SEQ ID NO: 110699 - DNA, 201 bp, Bos taurus
ggaaatctgttcttggatctcagctgcctcattcctctttgggagaagagaattcccagggcgacagttcatcagaacggcaggtaggaaagtgaagaatrcactgcagctgtgtaggcaatgtaggctacatggagaaggtcatttgaccagattatgccaggtaggttacgtgtgtggccactgctaggaccaaagtta

SEQ ID NO: 110700 - DNA, 201 bp, Bos taurus
tcccgtttagatatttatagttaattcacaatcctccaaggccaggtgtagtttactaattagaagtcattttataagcaatgttgcctggtaacatagaygactttcacctttattatgtttccaggggaacagagctaggagttaactcaaggtcatttttctggagagaaagagagcgagtctgtaaaccattcacat

SEQ ID NO: 110701 - DNA, 201 bp, Bos taurus
ccccgaatcttgaaagcgttgcgctaaatgaaagaagactccgaagaacatataccctcttcttccatttcatggcattctaggaagagcgaaactgtagkgacaggatgcagactgtggtggcctgaagccaggagctttggggggtgccacagggaacttttggggatgatgaaaatgttctacatcttcactgtggtg

SEQ ID NO: 110702 - DNA, 201 bp, Bos taurus
aatgaggtgagaagtgcttcctcgtcccttagttcctgaagcgtttgtgaaggtctggtgttatcttctttaaatatgtgatgggattcaccagtgaaatyagctgggcctgggctttcttcgtgggaagatatttcattactgctaatgctgctaggtcgcttcagtcgtgtccgactctatgtgacgccatggacggca

SEQ ID NO: 110703 - DNA, 201 bp, Bos taurus; identical to SEQ ID NO: 29629

SEQ ID NO: 110704 - DNA, 201 bp, Bos taurus; identical to SEQ ID NO: 29630

SEQ ID NO: 110705 - DNA, 201 bp, Bos taurus
aaaagttctcttaattacaacagaattaaatagagcattcttcagccttaaccttgttatttttcaaggtgagttattactaactcaattctaggatggcrttcagtagcctctctttgtagcagctgtctgcagagctatttagaagggatgtatctcaggctagatgcagctggagatggatggagtataactagatga

SEQ ID NO: 110706 - DNA, 201 bp, Bos taurus; identical to SEQ ID NO: 29631

SEQ ID NO: 110707 - DNA, 201 bp, Bos taurus; identical to SEQ ID NO: 69405

SEQ ID NO: 110708 - DNA, 201 bp, Bos taurus; identical to SEQ ID NO: 69406

SEQ ID NO: 110709 - DNA, 201 bp, Bos taurus
aggtgtgtgggtcagagagaggaaaacccagaacctgatgtggctgaacaaagcgcagataggaggaagaaccagcaggcgttgagattttaggattttarcctctctgatctttctgtttccaaaaaagatgaaaaccaaactgaccaatcagttgccccagccttagatcaatgcctgaacttgatctaacgcctgaac

SEQ ID NO: 110710 - DNA, 201 bp, Bos taurus
acttccgagaagagggaacagcactgcaaaggcctggggcgcttggaggattgtaagcggctccctgggctcagttggctgatgcaggatgaggtgggcayatccggacacgtggccagcactcgggtgaggcaagtgaagactaaatagataggatccaaccctgcccttgtacgatttcccttactcccctctaatcct

SEQ ID NO: 110711 - DNA, 201 bp, Bos taurus; identical to SEQ ID NO: 29635

SEQ ID NO: 110712 - DNA, 201 bp, Bos taurus; identical to SEQ ID NO: 69411

SEQ ID NO: 110713 - DNA, 201 bp, Bos taurus; identical to SEQ ID NO: 69412

SEQ ID NO: 110714 - DNA, 201 bp, Bos taurus; identical to SEQ ID NO: 29638

SEQ ID NO: 110715 - DNA, 201 bp, Bos taurus; identical to SEQ ID NO: 69416

SEQ ID NO: 110716 - DNA, 201 bp, Bos taurus; identical to SEQ ID NO: 29643

SEQ ID NO: 110717 - DNA, 201 bp, Bos taurus; identical to SEQ ID NO: 29644

SEQ ID NO: 110718 - DNA, 201 bp, Bos taurus; identical to SEQ ID NO: 29645

SEQ ID NO: 110719 - DNA, 201 bp, Bos taurus
tcaccgttttctccccatgggacctcctgggccgtgtcctgagaaaactgttcctatctgcatggacacagtgtcatgttgtcctcaaattgaaacctcakcaggtcctcagaagaccgagcactgacagcgctgacctgtggtatgtggaagtgaaacccgtactggtgctgaaggaggctgagctccgcaacagagcga

SEQ ID NO: 110720 - DNA, 201 bp, Bos taurus; identical to SEQ ID NO: 69422

SEQ ID NO: 110721 - DNA, 201 bp, Bos taurus; identical to SEQ ID NO: 69423

SEQ ID NO: 110722 - DNA, 201 bp, Bos taurus
ctgaagcctttgatgagaagtactgtcctaacaagaatcaccagattttcttgttcaaaaaggtctcaggggactctgaggtccttcagcatgcaaatgtrtatgtggacggttcctagagagccaactcctcattttcctattacatccagatgtccatttggaaagccctctcagaagcatcagatgcttaggacaact

SEQ ID NO: 110723 - DNA, 201 bp, Bos taurus
tgaagctctaacaaccaagtagggtaagagcagaaaggagaggggtgtgagcgctgcccactggggtaggtgggaagtccagacccacgccctgcatgttygcggccacctccaacaccatactcatctctacggcctgggattttggcttttaggcaacacatttagaaccacacctcagacccaaacttcttatcagtt

SEQ ID NO: 110724 - DNA, 201 bp, Bos taurus; identical to SEQ ID NO: 69430

SEQ ID NO: 110725 - DNA, 201 bp, Bos taurus; identical to SEQ ID NO: 69431

SEQ ID NO: 110726 - DNA, 201 bp, Bos taurus; identical to SEQ ID NO: 69432

SEQ ID NO: 110727 - DNA, 201 bp, Bos taurus; identical to SEQ ID NO: 69433

SEQ ID NO: 110728 - DNA, 201 bp, Bos taurus; identical to SEQ ID NO: 69434

SEQ ID NO: 110729 - DNA, 201 bp, Bos taurus
ttattccatagaataagtaatgaataaaatatcttaaaaggggtccatgtaatgtgaagagcaaaagacctagtttttatctacaaaaaagatttgtagckctgaggaaaggaaaagctttcatgcagaattaacctccaaagtcagaggttatcagagggtctatggaggtcaaacaggcatttctattactaggatata

SEQ ID NO: 110730 - DNA, 201 bp, Bos taurus
gccatgttgagtatcagtgaacgcacagtggcagtactgtaacataccttgcccccctaaataccttgccccggtgtctttgtggggggtgtgcatgtgtwcggtttctcagtaatttggggtgaattaagagatgtcagaagagaaggctagaattgatggtcaaagaccctagggatgatctttatgttgcaaatataa

SEQ ID NO: 110731 - DNA, 201 bp, Bos taurus; identical to SEQ ID NO: 69435

SEQ ID NO: 110732 - DNA, 201 bp, Bos taurus; identical to SEQ ID NO: 29646

SEQ ID NO: 110733 - DNA, 201 bp, Bos taurus; identical to SEQ ID NO: 29647

SEQ ID NO: 110734 - DNA, 201 bp, Bos taurus; identical to SEQ ID NO: 29648

SEQ ID NO: 110735 - DNA, 201 bp, Bos taurus; identical to SEQ ID NO: 29649

SEQ ID NO: 110736 - DNA, 201 bp, Bos taurus; identical to SEQ ID NO: 29650

SEQ ID NO: 110737 - DNA, 201 bp, Bos taurus; identical to SEQ ID NO: 29651

SEQ ID NO: 110738 - DNA, 201 bp, Bos taurus; identical to SEQ ID NO: 29652

SEQ ID NO: 110739 - DNA, 201 bp, Bos taurus; identical to SEQ ID NO: 29653

SEQ ID NO: 110740 - DNA, 201 bp, Bos taurus; identical to SEQ ID NO: 29654

SEQ ID NO: 110741 - DNA, 201 bp, Bos taurus; identical to SEQ ID NO: 29655

SEQ ID NO: 110742 - DNA, 201 bp, Bos taurus; identical to SEQ ID NO: 29656

SEQ ID NO: 110743 - DNA, 201 bp, Bos taurus; identical to SEQ ID NO: 29657

SEQ ID NO: 110744 - DNA, 201 bp, Bos taurus; identical to SEQ ID NO: 29658

SEQ ID NO: 110745 - DNA, 201 bp, Bos taurus; identical to SEQ ID NO: 29659

SEQ ID NO: 110746 - DNA, 201 bp, Bos taurus; identical to SEQ ID NO: 29660

SEQ ID NO: 110747 - DNA, 201 bp, Bos taurus; identical to SEQ ID NO: 29661

SEQ ID NO: 110748 - DNA, 201 bp, Bos taurus; identical to SEQ ID NO: 29662

SEQ ID NO: 110749 - DNA, 201 bp, Bos taurus; identical to SEQ ID NO: 29663

SEQ ID NO: 110750 - DNA, 201 bp, Bos taurus; identical to SEQ ID NO: 29664

SEQ ID NO: 110751 - DNA, 201 bp, Bos taurus; identical to SEQ ID NO: 29665

SEQ ID NO: 110752 - DNA, 201 bp, Bos taurus; identical to SEQ ID NO: 29666

SEQ ID NO: 110753 - DNA, 201 bp, Bos taurus; identical to SEQ ID NO: 29667

SEQ ID NO: 110754 - DNA, 201 bp, Bos taurus; identical to SEQ ID NO: 29668

SEQ ID NO: 110755 - DNA, 201 bp, Bos taurus; identical to SEQ ID NO: 29669

SEQ ID NO: 110756 - DNA, 201 bp, Bos taurus; identical to SEQ ID NO: 29670

SEQ ID NO: 110757 - DNA, 201 bp, Bos taurus
ttttgaagacactgccattgctttgcagcactgcaatggtgacatgccaaggaaactgtttgaaaataacagcaaaacaccgtggcaggaggcaggggccrtgtcagtcgaatgctctgcttctgaaagggtttgtaggtcaggctcagagggcttcgtcgtctctgaaatctgggtgacccagaaagaccccacggctgg

SEQ ID NO: 110758 - DNA, 201 bp, Bos taurus
atcagtgctgctcatcttaaacttagactcacctttttttcattgaagtacagttgatttataatattatattagtttcaggtatacagcatagtaattcmggctttttttttgcagattcgactccactgtaggttattacaggtaacggctagaatgccctctgcgtgcagtataaagtttgtaatttattttatgcag

SEQ ID NO: 110759 - DNA, 201 bp, Bos taurus; identical to SEQ ID NO: 29676

SEQ ID NO: 110760 - DNA, 201 bp, Bos taurus; identical to SEQ ID NO: 29677

SEQ ID NO: 110761 - DNA, 201 bp, Bos taurus; identical to SEQ ID NO: 29678

SEQ ID NO: 110762 - DNA, 201 bp, Bos taurus; identical to SEQ ID NO: 29679

SEQ ID NO: 110763 - DNA, 201 bp, Bos taurus; identical to SEQ ID NO: 29680

SEQ ID NO: 110764 - DNA, 201 bp, Bos taurus; identical to SEQ ID NO: 29681

SEQ ID NO: 110765 - DNA, 201 bp, Bos taurus; identical to SEQ ID NO: 29682

SEQ ID NO: 110766 - DNA, 201 bp, Bos taurus; identical to SEQ ID NO: 29683

SEQ ID NO: 110767 - DNA, 201 bp, Bos taurus; identical to SEQ ID NO: 29684

SEQ ID NO: 110768 - DNA, 201 bp, Bos taurus; identical to SEQ ID NO: 29685

SEQ ID NO: 110769 - DNA, 201 bp, Bos taurus; identical to SEQ ID NO: 29686

SEQ ID NO: 110770 - DNA, 201 bp, Bos taurus; identical to SEQ ID NO: 29687

SEQ ID NO: 110771 - DNA, 201 bp, Bos taurus; identical to SEQ ID NO: 29688

SEQ ID NO: 110772 - DNA, 201 bp, Bos taurus; identical to SEQ ID NO: 29689

SEQ ID NO: 110773 - DNA, 201 bp, Bos taurus; identical to SEQ ID NO: 29690

SEQ ID NO: 110774 - DNA, 201 bp, Bos taurus; identical to SEQ ID NO: 29691

SEQ ID NO: 110775 - DNA, 201 bp, Bos taurus; identical to SEQ ID NO: 29692

SEQ ID NO: 110776 - DNA, 201 bp, Bos taurus; identical to SEQ ID NO: 29693

SEQ ID NO: 110777 - DNA, 201 bp, Bos taurus; identical to SEQ ID NO: 29694

SEQ ID NO: 110778 - DNA, 201 bp, Bos taurus; identical to SEQ ID NO: 29695

SEQ ID NO: 110779 - DNA, 201 bp, Bos taurus; identical to SEQ ID NO: 29696

SEQ ID NO: 110780 - DNA, 201 bp, Bos taurus; identical to SEQ ID NO: 29697

SEQ ID NO: 110781 - DNA, 201 bp, Bos taurus; identical to SEQ ID NO: 29698

SEQ ID NO: 110782 - DNA, 201 bp, Bos taurus; identical to SEQ ID NO: 29699

SEQ ID NO: 110783 - DNA, 201 bp, Bos taurus; identical to SEQ ID NO: 29700

SEQ ID NO: 110784 - DNA, 201 bp, Bos taurus; identical to SEQ ID NO: 29701

SEQ ID NO: 110785 - DNA, 201 bp, Bos taurus; identical to SEQ ID NO: 29702

SEQ ID NO: 110786 - DNA, 201 bp, Bos taurus; identical to SEQ ID NO: 29703

SEQ ID NO: 110787 - DNA, 201 bp, Bos taurus; identical to SEQ ID NO: 29704

SEQ ID NO: 110788 - DNA, 201 bp, Bos taurus; identical to SEQ ID NO: 29705

SEQ ID NO: 110789 - DNA, 201 bp, Bos taurus; identical to SEQ ID NO: 29706

SEQ ID NO: 110790 - DNA, 201 bp, Bos taurus; identical to SEQ ID NO: 29757

SEQ ID NO: 110791 - DNA, 201 bp, Bos taurus; identical to SEQ ID NO: 29759

SEQ ID NO: 110792 - DNA, 201 bp, Bos taurus; identical to SEQ ID NO: 29760

SEQ ID NO: 110793 - DNA, 201 bp, Bos taurus; identical to SEQ ID NO: 29764

SEQ ID NO: 110794 - DNA, 201 bp, Bos taurus
ctgtcgggcccgcctggggtggatcactgctgtaccattgactagaattaattaatctcagggttcagaagatcactgaagggctacattcaaccacaccraacacatggcctcctggtatcctacccctcttcagaaagtagaagtaactcagcaacctggccaggaatttagttcaaaccaggactgggtgatgataat

SEQ ID NO: 110795 - DNA, 201 bp, Bos taurus
ttaaaaatctttctatatattgttaggaaggatgatgttgtcagacatgtttcttaaatcaatgcatgataagtctgaagtgaggtcaactcattcaacarttgagatgtggaaatacgaaggatgaagtggaagagcagagagtttagtatttgttatatttctattaatactcttcagctatatgtaactatcccacgt

SEQ ID NO: 110796 - DNA, 201 bp, Bos taurus; identical to SEQ ID NO: 29765

SEQ ID NO: 110797 - DNA, 201 bp, Bos taurus; identical to SEQ ID NO: 29769

SEQ ID NO: 110798 - DNA, 201 bp, Bos taurus
aaaagacactccacttgaacagaaggaacgtcagcacttccagatatcaagtgcctctagggcgggtatcctaagtctagactgcatctcaagaaaactgragttgacctccagagaggatccccgcggtacacaccgcagtttaaagcccattcctcctggccatttctggcagacctctgatttccacttcttgtctga

SEQ ID NO: 110799 - DNA, 201 bp, Bos taurus; identical to SEQ ID NO: 29770

SEQ ID NO: 110800 - DNA, 201 bp, Bos taurus
tctggtattcttgcctggaaatcccatggacagaggagcctggtgggccacagtccagagggtcataaagagtcgggcacgactaagcatgcacacggccrgtccattggtaaggcagagaaagggtgtgggtgtcccatctagtgaggagagcagcagagagacggttaaatcatctgtgtagggcagttcctccaggtc

SEQ ID NO: 110801 - DNA, 201 bp, Bos taurus; identical to SEQ ID NO: 29773

SEQ ID NO: 110802 - DNA, 201 bp, Bos taurus
agggcatctgagcagctggcagctagacaattactgtgtcctttgggatgagcctgtgtgggcacacatgtcatttggttggatggttaactgccctgtcygctgggccaaggcagacattcagaaccaaccagaaatgccatctctgccctttggaaaaaacgcctgatacatcagggcatcatcatctcctccctaaaa

SEQ ID NO: 110803 - DNA, 201 bp, Bos taurus
tctcctactgggcccttcctttatttatttagaggactcagcctttcctctgagtaaatattgaacagatcttttcataccacccagttaaacagtggcarattgttatcttgtctccacctggccctgtgcatggctacggtgcttcctgctttaggccctaacttccttggtggagcaggcggagcccctgctctgtgg

SEQ ID NO: 110804 - DNA, 201 bp, Bos taurus
tcttagagcctttggaaaggaaaactggcctgctgatacctggattttagcccaaccagactcatctctgatctccagaaccgtaacaaattgtgtctcaytttaggccactttctggtaaattgctacagtagcaatagcaaacgaacagagttacctcgatgtcttcctctagttgacaaaaattacaaaagaactaat

SEQ ID NO: 110805 - DNA, 201 bp, Bos taurus
tgttccaaagaaatgtattccacttgagaatggccagggtaatttttcagcaatggaatcagacatttttgaggggggaaacctaataaatggcctcgctstcagtggtcagaggaggtcttttggaggatggaaaacagaatccaaaggcaggcattgattccccagaggagaaaggataaagctgagatgaaaatcagg

SEQ ID NO: 110806 - DNA, 201 bp, Bos taurus; identical to SEQ ID NO: 29774

SEQ ID NO: 110807 - DNA, 201 bp, Bos taurus; identical to SEQ ID NO: 29775

SEQ ID NO: 110808 - DNA, 201 bp, Bos taurus
aacgtcaccagcaagaccttgatttagttttaggtaattttttctctcatctttccttttctccatgatactgctgaattactgctcccatgatacgcacyccccgccccctacaatgttgggcgattgttcctccgggtcctttatgtgtgacggttcttggatgcagacaacagaaactcaggctcggcaaatataggc

SEQ ID NO: 110809 - DNA, 201 bp, Bos taurus; identical to SEQ ID NO: 29776

SEQ ID NO: 110810 - DNA, 201 bp, Bos taurus; identical to SEQ ID NO: 29778

SEQ ID NO: 110811 - DNA, 201 bp, Bos taurus
aaaaagtgtcaatgcatatgctacttaagtgccttttaaaaacgaacaaaaatgggagcagagaaagctaaaggtccagggagtggaatggaaaggtggcyttgaagtagggaagaacaaatctgactccacgttgcactggtttcttttactttatcctttggattcaattgcttttgctacaagctaagaatgttgccc

SEQ ID NO: 110812 - DNA, 201 bp, Bos taurus; identical to SEQ ID NO: 29780

SEQ ID NO: 110813 - DNA, 201 bp, Bos taurus; identical to SEQ ID NO: 29781

SEQ ID NO: 110814 - DNA, 201 bp, Bos taurus; identical to SEQ ID NO: 29783

SEQ ID NO: 110815 - DNA, 201 bp, Bos taurus; identical to SEQ ID NO: 29785

SEQ ID NO: 110816 - DNA, 201 bp, Bos taurus
accaccaatgacaggtggaggagggaatacggaagcctagcatttggccattttaacccccagcgtccccataaggtcaactgatgctgtctcccgtcatyccacacatgcgtttcttctcccttgacaggtgtcaatctccagggtactcattagtaaacatcctatactttaaactccatttcagagtctgccccccgg

SEQ ID NO: 110817 - DNA, 201 bp, Bos taurus; identical to SEQ ID NO: 29787

SEQ ID NO: 110818 - DNA, 201 bp, Bos taurus; identical to SEQ ID NO: 69522

SEQ ID NO: 110819 - DNA, 201 bp, Bos taurus
ctcggatccacatggtatgaacagatccaggccttgaaatctaccgagagccttccgagttcagtgcagcgacactggccaggccccattcaccagccctrgcgtttgtgccctctgaggaccacctgcagcttcggttcctaataagtccatgactcagtaagcacagccacagaccaggcctggctgcctcttctggaa

SEQ ID NO: 110820 - DNA, 201 bp, Bos taurus; identical to SEQ ID NO: 69527

SEQ ID NO: 110821 - DNA, 201 bp, Bos taurus
ttccatggacagagaagcctggcgggctccagtgcatggggccccagagagtgagacatgactgagtgactttcatcatttcatcatcataaaggatgcakagggaggaggccacgtgaagatggagcaaagatgggagagaggtgactacatgccaaggaacacctggagccatcagaagccggaagaggcaggaagcgt

SEQ ID NO: 110822 - DNA, 201 bp, Bos taurus
agacagaggcgctcctggctggggtgatagtgcggatgtgggatgctcctctgggttgacagtgaactcaggacgtaccaggccagcttagctagcccagyggtcatctctgcagccccctcctcacctctccccagccctccctcgggggagctgacccctggcagccaagcttgcctctggcgacccctccagacccca

SEQ ID NO: 110823 - DNA, 201 bp, Bos taurus; identical to SEQ ID NO: 29797

SEQ ID NO: 110824 - DNA, 201 bp, Bos taurus; identical to SEQ ID NO: 29798

SEQ ID NO: 110825 - DNA, 201 bp, Bos taurus; identical to SEQ ID NO: 29799

SEQ ID NO: 110826 - DNA, 201 bp, Bos taurus
attttgagacattagtctgccatcttctcagtcagctggctttccaaataaagttgttattccttaccgtaacacctcatatctcagatttaccggcctaytgtggatcaagagcagagtgagtttggattcagtaacagcttctaaagaatgaggacacttcagctgaggcctggacgtttcactgaccacattcagacc

SEQ ID NO: 110827 - DNA, 201 bp, Bos taurus; identical to SEQ ID NO: 69533

SEQ ID NO: 110828 - DNA, 201 bp, Bos taurus; identical to SEQ ID NO: 29802

SEQ ID NO: 110829 - DNA, 201 bp, Bos taurus; identical to SEQ ID NO: 69537

SEQ ID NO: 110830 - DNA, 201 bp, Bos taurus; identical to SEQ ID NO: 69538

SEQ ID NO: 110831 - DNA, 201 bp, Bos taurus
catcttgcccacatggccctggggctctctcggcagtgtgcaaggagttctcaaatccttcgtgtgggatggcgaggccagagtttgtctccaactccatmctaagggagggagtcttaagccttgcctgagccttagcaatctgcaaggccactaagacgggttcccctcgcagatgacacaggaagtcacaccgtctta

SEQ ID NO: 110832 - DNA, 201 bp, Bos taurus; identical to SEQ ID NO: 29806

SEQ ID NO: 110833 - DNA, 201 bp, Bos taurus; identical to SEQ ID NO: 29809

SEQ ID NO: 110834 - DNA, 201 bp, Bos taurus
cctctcttcctggttaacgtggcccctgggggtgtcagctcttttcgggcaccttataggctgtgagggcagagagcttccaagcttcagaggaggcctcygggcaggaaagcagagaggactgggctcgaccatcacgcagtgcaagatgagtctgagcctgcgtggcaaggtgccctagggctgaaacccaggcacggc

SEQ ID NO: 110835 - DNA, 201 bp, Bos taurus; identical to SEQ ID NO: 69549

SEQ ID NO: 110836 - DNA, 201 bp, Bos taurus
gtctctcccctgggccgcttacaacacggcagccggctgctctcagaagccggaagcacaggagcgggagagaccgagacgcaggccagcgtctttgtacmatgaagtctcagaagtggcatcccctcactttcccgaggagcgggtcgtcactgggttctcctacacccagggcagcaggctccacagaggggtggccac

SEQ ID NO: 110837 - DNA, 201 bp, Bos taurus; identical to SEQ ID NO: 69550

SEQ ID NO: 110838 - DNA, 201 bp, Bos taurus
tgataggtccaccacgtgtgacctctagtctcgagggcaccttgtggtccaagatagaggcctggttccatccatcatgtctgcactctggccagagacgygaaggacgagaagacacagagcaacaggtgactgccagccggcttggacggaagcttcagaggcccctgcaggacgtgctgaagccctgtgtgtgcagca

SEQ ID NO: 110839 - DNA, 201 bp, Bos taurus; identical to SEQ ID NO: 69553

SEQ ID NO: 110840 - DNA, 201 bp, Bos taurus
aaaatccaggcccaacctgctcagacctcaggaaatgattcaccagcatctacaatagtcccattattttaaattaattaaaccatgctttgtagggcccwatgatcttgaaaagcgttccaggtttgatctgactgatggcttgctgcttttgttttgttttgcatttttgcaggtcgttagtctggtttaatacgctgg

SEQ ID NO: 110841 - DNA, 201 bp, Bos taurus; identical to SEQ ID NO: 29813

SEQ ID NO: 110842 - DNA, 201 bp, Bos taurus; identical to SEQ ID NO: 29816

SEQ ID NO: 110843 - DNA, 201 bp, Bos taurus
ggctgggcattgggagaagctgttgtgcaagtgtggctgcaatcaaggtttcagataatcatacagggaatgtaaccctgggcaagacagttctctggggyggagggcagttcccagggagggatgaaggcctgaatggtcagcatttgatattactagcaactggggggaggggtgactcagaaggagggcacaggtgaa

SEQ ID NO: 110844 - DNA, 201 bp, Bos taurus
gttgattccagcctgtgcttcttccagcccagcgtttctcatgatgtactctgcgtatgagttaaataagcagggtgacaagtgactccacacaaatgtgygttgagtatatattgttgctgttgttgagtcgttaagttgtgtctgactcttttgtgatcccgtggattgtagtctgctaggctcctgtctgtctatggg

SEQ ID NO: 110845 - DNA, 201 bp, Bos taurus; identical to SEQ ID NO: 29817

SEQ ID NO: 110846 - DNA, 201 bp, Bos taurus; identical to SEQ ID NO: 29818

SEQ ID NO: 110847 - DNA, 201 bp, Bos taurus; identical to SEQ ID NO: 29820

SEQ ID NO: 110848 - DNA, 201 bp, Bos taurus; identical to SEQ ID NO: 29821

SEQ ID NO: 110849 - DNA, 201 bp, Bos taurus; identical to SEQ ID NO: 29822

SEQ ID NO: 110850 - DNA, 201 bp, Bos taurus; identical to SEQ ID NO: 29823

SEQ ID NO: 110851 - DNA, 201 bp, Bos taurus; identical to SEQ ID NO: 29824

SEQ ID NO: 110852 - DNA, 201 bp, Bos taurus; identical to SEQ ID NO: 69562

SEQ ID NO: 110853 - DNA, 201 bp, Bos taurus; identical to SEQ ID NO: 29827

SEQ ID NO: 110854 - DNA, 201 bp, Bos taurus
cgcagttgggactcagtaacgggaaattcgggaaattgtgagcaactaagtaaaaagctccttagagttgccctgctaagggccaaaaggccacatccacraacatccactcctcactggttgagagatggtcctgggtatccgcagcccctcacctccagggagcgtccgcaggcctgctgagcacgcttacgtggcttc

SEQ ID NO: 110855 - DNA, 201 bp, Bos taurus; identical to SEQ ID NO: 29828

SEQ ID NO: 110856 - DNA, 201 bp, Bos taurus; identical to SEQ ID NO: 29831

SEQ ID NO: 110857 - DNA, 201 bp, Bos taurus; identical to SEQ ID NO: 29832

SEQ ID NO: 110858 - DNA, 201 bp, Bos taurus
ctcatgaccaggggatagtgcagaaggtcacagatggccacgcagcagtcagtggctcccagcataaggaagaagcacatttgtgtagcacaagtgaaaaragaaatggttcctgtctgggcccaaaggtcgacgagcatcctgggaagagtgacagatacctaacagatttctaggaaagaaaaactgccaagggaaaaa

SEQ ID NO: 110859 - DNA, 201 bp, Bos taurus
accagcaaaagcatacgctctatagtagtgttgtacgatagtgaaagccgtgaaagaggagagtctcagtgggtccccttgtactggcatccttgaactgyaggaggattgcccacattctagctgctgctgtagcagtggtcccatgccctcagcatagacccccaacagaaaaggttgtgactgattccttgatttcta

SEQ ID NO: 110860 - DNA, 201 bp, Bos taurus
tctgagtatcagaatgtgtctgaaaaagcattgttctcaaatgatgttctctagagacaatccttttttttttttaaggtttcactaatttggaccaagarattacttatgtttaaatgacgactcaatacatggcccatttctattaacattgtattattgtagagttattttaaattttccttcaccaaaatctaaatg

SEQ ID NO: 110861 - DNA, 201 bp, Bos taurus
aataaagggagtcacacaatgttttcggtttcccagagcatctaaagttatgtttacactatactgtagcctattaagtgtgtgatagcattatttttttwaaaataatgtatgtgggtgctcagttgtgtccaactctttttaagaccccatggactatagcccaccaggcacctctgtccatgggattatcctggcaag

SEQ ID NO: 110862 - DNA, 201 bp, Bos taurus
agtgaaaaattctaaatcttcatgagatcaataacaaaacagtaacagactgagttaccggaaaatataaaagcaataatattttaacataatactcacartggggaaaggatcctctacagacagctttgtttaaaatggttacaagaaacatatggcagtttttaaaatcagactccattttctctatagattccatcc

SEQ ID NO: 110863 - DNA, 201 bp, Bos taurus
tgttttgggttcaaatctaatggcctatttttaatatacatgtgaataccctcaaacacctttctttaaaaaaccaaaattctgcttctcattaataaagyctttagactatgaaattaggttaatggatcttaccatagggtttcccgaataacctgtgtttcagtaacaaaaactctgtcatctggaacatataacggg

SEQ ID NO: 110864 - DNA, 201 bp, Bos taurus
gtacttcttggaggaggcattagaaactttgggggtggggcccccaataccaggacctatccagactcctcttctaggtctttctggccttcccaggtctytccataccagagagaggcttaggaatgttttggggtgtctccaaagaccagtcctcaggcaggaggacagccaagttcaaggtgcctccacagtctccag

SEQ ID NO: 110865 - DNA, 201 bp, Bos taurus
cctcgcgggatcccacctcctctggagtctgggtgcccgctctcaccatccagaacttctggagtccgtcctgagactcgctacagaacgagaagggagaytggacctttggcggccccggcccggccctctgcccgcccacccgctgcagcatgcaaggctcctcacctggtgccgacgcggacctggggctccatgtgg

SEQ ID NO: 110866 - DNA, 201 bp, Bos taurus
tttggcccacgctagtcagaggtgcctacataccacagagtcccccagtaaaaaccttgggcactgaattcctaaggagcttccctgtggacatttcacaygtgtggccacaactcacagctggaggagttaagcgcatcctaagtgactctactgggtgaagacccttggaagctggcaccttgttttctgcagacttca

SEQ ID NO: 110867 - DNA, 201 bp, Bos taurus
aaccatccttctggaagcatcttattatataggatgaagggattcttgagtccatggtgtctgaagccctgcatcataagaaggcctgagtgtctttgctrgcacttcagaatttacaaagcaatttttccactggttttctccaaatgcagatcttattaagtccagtcacaggaacatgaaaggtgctgacagcgtaat

SEQ ID NO: 110868 - DNA, 201 bp, Bos taurus
aacaatgaacacaaactggtttttatcatggtgtaaaggaagcagaacaaaacatttctataactggtgggaatcacatgagtaaatgacagagaacatgragatacaataaatggcatttcctcataatttttgaataaagttgtgcttggattggagaagattaatgaaatccaaaaagaaagtccatgtttttttgtc

SEQ ID NO: 110869 - DNA, 201 bp, Bos taurus
gtgaaaaaagtgaaaacacaacacttcctaacactatacaaagaataaacttaaaatgaattaaagatctaaatatgaaggcagaaacctcaaaactcttrgagcaaaatataaacagagcactctctgacataaatcacagcaaaatcctcattgacccatctccaagagtaatgaaaagaaaaaaataaacaagttatt

SEQ ID NO: 110870 - DNA, 201 bp, Bos taurus
gtcccaagggcctgcttgctggagtgagcaaggtcctagccggggccaagcaggagaccaagtcttcatcctgtgacccctctctggagtgtgtgccagtytctggggaacgagggacacaaggccaccctgaaggctcattttcccctttagggtctgcagccgccatgggatccaacacattcaggaagaacaaagtcc

SEQ ID NO: 110871 - DNA, 201 bp, Bos taurus
attccaatgggctactgtgaggtggacgcatggggaggctccatttatgacctggcatgccttccacttctcataggccacgagttcatgttagaacggarccagtgctcactaacttctgacatgcccaggtgtttctctgtatggagccttcagaagattcatagtactgtttgcttaggatgttattgcaggtgactg

SEQ ID NO: 110872 - DNA, 201 bp, Bos taurus
acatgcagtgttctgctcctattttgctgaaggattggtgtgaagcatttcgcactggagtttgctggcttttgggtggagcttggtcttagtggaggccyttgggagaactcttgcctattaaggttctgtggagttgggagttcactagtggtccaaggtcctagaatcaagtctcctgcctctggtgttcaggcctga

SEQ ID NO: 110873 - DNA, 201 bp, Bos taurus; identical to SEQ ID NO: 69569

SEQ ID NO: 110874 - DNA, 201 bp, Bos taurus; identical to SEQ ID NO: 69570

SEQ ID NO: 110875 - DNA, 201 bp, Bos taurus; identical to SEQ ID NO: 69571

SEQ ID NO: 110876 - DNA, 201 bp, Bos taurus; identical to SEQ ID NO: 69572

SEQ ID NO: 110877 - DNA, 201 bp, Bos taurus
cacttcttcaagtattttgcctatttctttccttttcttttgtgactcccaatatacgtttgctgatattcttgattatgtttcacaggccctgaggctcrtaatttttcttgactcttttcctttcaattcttcagattttatatcaatggacttgtctctaaatcccctaattctttcttttggctattaaaatctgct

SEQ ID NO: 110878 - DNA, 201 bp, Bos taurus
tgtagggtcttatccaggactggttggatcatgtgacttagacttgtgtggggtttcttgcttccagtatccaagtctgttctctggtgggccctaatccyaagagatgactgatggttccacagtgcttcaggtgggaggaagtaaactgaaggcacaatggccagccttgttccaaggaaaaagacacagaaccgggtc

SEQ ID NO: 110879 - DNA, 201 bp, Bos taurus
ccaagtttagcgttagatatcaggatgccaacattcacctctaggaaactgcctatgaaaggttagcaatccagcaatcccgtaaaagggccttgtctccratgtccatttcataccagggtatggagaataacggacaaagaacaacttctcagagggaaaaacttggcatggccagatgggcattccattccactgcca

SEQ ID NO: 110880 - DNA, 201 bp, Bos taurus
atctaggagtagagctgggactctagtcacctgaggaccaggagaccagaagtatatttaagactgggcaggacatgatttgctgcccacagagataaccytttaggtcaaggccaggagtactgttacctgacttctaccctagcccacctgagaaatgacaaaatccaatgagagtgctggcaatgagggcagaaaaga

SEQ ID NO: 110881 - DNA, 201 bp, Bos taurus; identical to SEQ ID NO: 69576

SEQ ID NO: 110882 - DNA, 201 bp, Bos taurus; identical to SEQ ID NO: 69577

SEQ ID NO: 110883 - DNA, 201 bp, Bos taurus; identical to SEQ ID NO: 69578

SEQ ID NO: 110884 - DNA, 201 bp, Bos taurus; identical to SEQ ID NO: 69579

SEQ ID NO: 110885 - DNA, 201 bp, Bos taurus
ggcacacatcagccaaccatggtgcagccagctcagagggagaaggaggagccctctgcaccagcagagagggagggcagggggagggggcccctgtcaaygtcttccttatcctggtgccaatgacttttcctccagccagcgtgagacttccaagtgacaggcagcagggaacatggcctgtctacccagctacccctt

SEQ ID NO: 110886 - DNA, 201 bp, Bos taurus
gccacagtctctccaaggtccaacccctatgagccttggccacctcaaggtgacctatcatcatcagtccttggggcgcccactctgggtggggaagggaytgggaaacatggccttaccaggctaatgattccatcaaaggagctgaagagacagggggaggggccacatctggtgggaatggtgaagggagtcagacca

SEQ ID NO: 110887 - DNA, 201 bp, Bos taurus
ggtgcaggtactagtgcgatcacaaaagtctgaggcccagttccgaatgactgggagagaaaccatggttggactggcttgagtcagatgctcacacctgytcccatcagccatggccagagaggcaggggcagagaaaagtggtgtgggctggggaagcttccccaaaagacatccgctccataggcagagaactcaggg

SEQ ID NO: 110888 - DNA, 201 bp, Bos taurus
aggcctttcctcagctggtgagatggacacacatcctcaggagagcagcctggtatggactgcacacacaggtacacacacatgcatacacacctcgacarcccctggccagggccctctgtcctcacctagtagggaaacgtcagctcggagtcccagagctctgtgtctgggcctcggctctgttcccagtgtaagcca

SEQ ID NO: 110889 - DNA, 201 bp, Bos taurus
cagaaattctgctgcagaagacacttggccttcctttggatagaacaacccagtgcttcgtcttggtttaggttgctatttcaagcttgactgttggccartggtgacctgaacaaccctggagaggtcttgcagtagctgctcatggctgcctgagcttgcctctgggaaggacgaggtggggtgatgtgcatacaagcc

SEQ ID NO: 110890 - DNA, 201 bp, Bos taurus
caaaaaaacaactaggcccaacatggtggaagacttgacttccagtagacatggagcctcattatgtgctcattgtaatacatcagctaaacgacacaccygcagagctcccccatgagctctgaggtcctgaaaggccaaaggtgggtggtggcacaattcctggaaatcctcgacccttcccccaaataactggaataa

SEQ ID NO: 110891 - DNA, 201 bp, Bos taurus
tcatacacaaatttcttgttctcattctacctcagtttctgtcttgcctacagcctccttccccctaccccaagctccaccccagatatgagataaatacrctttggggatgaccctgactactagtttaaatttgtcgtttctgttagtgtagctcaaaagtgaatactgcaatgagtagaaattacagtaattattttt

SEQ ID NO: 110892 - DNA, 201 bp, Bos taurus
aacaggtgcctttcccaagcttgctctgcaggtataatgctgcacgttactatcagttcatcgctctgaattccactgtttatttgtgagttgctacttcrcatggccatttctagatagtttttgtctgtttccaagaagtaaggcaatgttcagttggtttaacagaccaggctgctcagttttattccagccttggta

SEQ ID NO: 110893 - DNA, 201 bp, Bos taurus; identical to SEQ ID NO: 69581

SEQ ID NO: 110894 - DNA, 201 bp, Bos taurus
ttgatcaataccctcacctttggagggccctaagctttggcatcttccccctaactccacaagacccccaaaattacagctaaaattcctaatgcactttkccagcacgttgtgactttgatgggccctttggatgagaacccacagggatttcttcctcctctcatccccatttttcctccccagggggtgtactttggg

SEQ ID NO: 110895 - DNA, 201 bp, Bos taurus
atagctgcacacagagttttggttttcttcaaaataaaaccctgaatggagttcaggttgggacaacgtttaagtccagagttagagagtggagactgagsggaaggcctggctgtggggttaggaggttcaggatgggccccaccccagcctgtgtctgtgtcagattccctcctgtgagaagtgaggacggtgcccagc

SEQ ID NO: 110896 - DNA, 201 bp, Bos taurus; identical to SEQ ID NO: 69582

SEQ ID NO: 110897 - DNA, 201 bp, Bos taurus; identical to SEQ ID NO: 69583

SEQ ID NO: 110898 - DNA, 201 bp, Bos taurus; identical to SEQ ID NO: 69586

SEQ ID NO: 110899 - DNA, 201 bp, Bos taurus; identical to SEQ ID NO: 69589

SEQ ID NO: 110900 - DNA, 201 bp, Bos taurus
aacatcagaggagctttcacaacaaattctttaaacaaattcacagctgtcagccatgatacgagatttaattaggccaccctgagttgtgctgcatacartctttactgtaatcaggttctttgttgtacccactgtgtggccactgaggaaaggtccttaagaggcacactctcccatgggtaatcacacccggagccc

SEQ ID NO: 110901 - DNA, 201 bp, Bos taurus; identical to SEQ ID NO: 29834

SEQ ID NO: 110902 - DNA, 201 bp, Bos taurus
gataaaattcaatactgttgaaaggaagatggcataatccaaattcctacaaattatccacaatgtctaccacataataaaatattactaataatgcaaakaagcaggaaaatgtgcctattcaagaaataaaatttactagaaacagatccacagatgaccaagcacttggtaattaacagaacttaatagaactttaaa

SEQ ID NO: 110903 - DNA, 201 bp, Bos taurus
gttgtcagctcagtgtcaacaaggccttgctgacaataacagaaaggagggacactcacaacgcagtgagcttcctgtcactgaagtgccccccgcagagygtggccagtctgtcaggagagcaatagagggaatgttaaaatggaccggacgttggtcaatgattttaaagtatccttttgttgtaagaccgtgggccta

SEQ ID NO: 110904 - DNA, 201 bp, Bos taurus; identical to SEQ ID NO: 69591

SEQ ID NO: 110905 - DNA, 201 bp, Bos taurus
taattaaataattaagcatgagtattcaattggggatcacagataaaaggactacttctaaacctaaatttggaatgctggaataaaatgacaaaaatgakttatttgtacttcaagtttgttaaaattatctaatgagttttggattgtttttgactaaaaaacgttggatcttaaattaccatgagaaactataatggt

SEQ ID NO: 110906 - DNA, 201 bp, Bos taurus; identical to SEQ ID NO: 29839

SEQ ID NO: 110907 - DNA, 201 bp, Bos taurus
tgttcagggaagaatatggtaattctattgtaatacaaagggtaaagcgattgagtatgtatgagagaagataataaggtggtggccttgttagtgcaccrtaaaatagtttaagggatcatctgtgtgggaatgaattaggtttatttcttgcaactccaacaggccgcggtagctccatatggtagaaagtagaggtag

SEQ ID NO: 110908 - DNA, 201 bp, Bos taurus; identical to SEQ ID NO: 29840

SEQ ID NO: 110909 - DNA, 201 bp, Bos taurus; identical to SEQ ID NO: 69595

SEQ ID NO: 110910 - DNA, 201 bp, Bos taurus; identical to SEQ ID NO: 29842

SEQ ID NO: 110911 - DNA, 201 bp, Bos taurus
tgcatacatttttgaaaaggcactttaaaggtttaataaagatgtgaaaattacattttacttttacatctcaaaaagtacataaaactgttaaaagaccrtatttaatcatggtttttcttgcagcattaaaatttgtctgttctacatgacaaagatatttacaggccttagagaagttagcctattaggaaatcctca

SEQ ID NO: 110912 - DNA, 201 bp, Bos taurus; identical to SEQ ID NO: 29843

SEQ ID NO: 110913 - DNA, 201 bp, Bos taurus; identical to SEQ ID NO: 29844

SEQ ID NO: 110914 - DNA, 201 bp, Bos taurus; identical to SEQ ID NO: 29845

SEQ ID NO: 110915 - DNA, 201 bp, Bos taurus; identical to SEQ ID NO: 29846

SEQ ID NO: 110916 - DNA, 201 bp, Bos taurus; identical to SEQ ID NO: 29847

SEQ ID NO: 110917 - DNA, 201 bp, Bos taurus
aaaaccatgagaaccatagataacacatgtccagccattcaacatagcccattaaaaagtgattacagagtcataggaaaggatgcacttcgactaaatgmgagctttgtaatgatccaagctactgtcttcctaatctttgcagtggcctactagaacaggagagaagtgatcttttgcatatcacaaacatctattggg

SEQ ID NO: 110918 - DNA, 201 bp, Bos taurus; identical to SEQ ID NO: 29848

SEQ ID NO: 110919 - DNA, 201 bp, Bos taurus; identical to SEQ ID NO: 29850

SEQ ID NO: 110920 - DNA, 201 bp, Bos taurus
agctgaggcttttgtatctaattttacaaatggatattaaatatcttgatcattctttgggccccctataacatactagacataataggtggcaacaaatrtgcccacacttagaataacgtcttgcaaatattgaaagtgtagattctgaactcatatacagcattcttccctctatttcttgctggtctctggccctac

SEQ ID NO: 110921 - DNA, 201 bp, Bos taurus; identical to SEQ ID NO: 29851

SEQ ID NO: 110922 - DNA, 201 bp, Bos taurus; identical to SEQ ID NO: 29852

SEQ ID NO: 110923 - DNA, 201 bp, Bos taurus; identical to SEQ ID NO: 69607

SEQ ID NO: 110924 - DNA, 201 bp, Bos taurus; identical to SEQ ID NO: 69608

SEQ ID NO: 110925 - DNA, 201 bp, Bos taurus; identical to SEQ ID NO: 29854

SEQ ID NO: 110926 - DNA, 201 bp, Bos taurus
aagtgtatttataaagtatattcaaacataattactatttaagaataagtaaattttcatgggaacaaaatgataaattgttctaagaatgcaaatgaccygctgcttggtacaaaaactagactgttatttgaatggattaaaacttcataatttgaaatagaaggcacataagtaacatctttcttccccaaatcgtaa

SEQ ID NO: 110927 - DNA, 201 bp, Bos taurus; identical to SEQ ID NO: 29855

SEQ ID NO: 110928 - DNA, 201 bp, Bos taurus
tccttgggttttccaaatatctgtgtagaagttcttccttaagcaatgaaatatttctatgcatttttagagcaaatagaagattcaaatgggaagaaatktaatttttttgctatgttgattttggtctcctgattggcctctcgtgtcatttctcagatgtagctgaaatcaagagtagtcagttgacttaatgagtca

SEQ ID NO: 110929 - DNA, 201 bp, Bos taurus; identical to SEQ ID NO: 69611

SEQ ID NO: 110930 - DNA, 201 bp, Bos taurus; identical to SEQ ID NO: 29857

SEQ ID NO: 110931 - DNA, 201 bp, Bos taurus; identical to SEQ ID NO: 29858

SEQ ID NO: 110932 - DNA, 201 bp, Bos taurus; identical to SEQ ID NO: 29859

SEQ ID NO: 110933 - DNA, 201 bp, Bos taurus; identical to SEQ ID NO: 29860

SEQ ID NO: 110934 - DNA, 201 bp, Bos taurus
tgcatattaggataaagaaatccatctataaaaagaaagctaaaaggtgattttatgaagtgtagataaagcagcactgccatatagtttaacatttttcyagcatgtagttgaaggatccctgatgagctgttaaatacctcctaacgccacccctttcctttcctatagttcctacacgttaatttcccttgagaatgt

SEQ ID NO: 110935 - DNA, 201 bp, Bos taurus; identical to SEQ ID NO: 69614

SEQ ID NO: 110936 - DNA, 201 bp, Bos taurus; identical to SEQ ID NO: 69615

SEQ ID NO: 110937 - DNA, 201 bp, Bos taurus
gtgcattctaaatgtatttcttcaaatttttttattgtaagaggagagaaacaccttaagataaatgtctgtgctaattttttttatggcttattgactcyaacaagcatttgagaatcttttgagatttcttaattgagattagaggtgatgagttattttattacctctaagccaatgggatggagtttgtattgtaaa

SEQ ID NO: 110938 - DNA, 201 bp, Bos taurus; identical to SEQ ID NO: 29862

SEQ ID NO: 110939 - DNA, 201 bp, Bos taurus; identical to SEQ ID NO: 29865

SEQ ID NO: 110940 - DNA, 201 bp, Bos taurus; identical to SEQ ID NO: 29870

SEQ ID NO: 110941 - DNA, 201 bp, Bos taurus; identical to SEQ ID NO: 29872

SEQ ID NO: 110942 - DNA, 201 bp, Bos taurus; identical to SEQ ID NO: 29873

SEQ ID NO: 110943 - DNA, 201 bp, Bos taurus; identical to SEQ ID NO: 29874

SEQ ID NO: 110944 - DNA, 201 bp, Bos taurus
acagggccttgtctctcatactaagtatgaatgtgtgacatccaagcatccttctggaacaagaccattgataccaaacgagatgtggtttattctaggayggtgaaagtcatctgtggcccttaggaaagctagattcatggacctcaccattgatactagtagttttgaagaaattgctttagtagttatgaagtgaag

SEQ ID NO: 110945 - DNA, 201 bp, Bos taurus; identical to SEQ ID NO: 29878

SEQ ID NO: 110946 - DNA, 201 bp, Bos taurus; identical to SEQ ID NO: 69627

SEQ ID NO: 110947 - DNA, 201 bp, Bos taurus; identical to SEQ ID NO: 69628

SEQ ID NO: 110948 - DNA, 201 bp, Bos taurus; identical to SEQ ID NO: 69629

SEQ ID NO: 110949 - DNA, 201 bp, Bos taurus; identical to SEQ ID NO: 29879

SEQ ID NO: 110950 - DNA, 201 bp, Bos taurus; identical to SEQ ID NO: 69630

SEQ ID NO: 110951 - DNA, 201 bp, Bos taurus
ccactccttggtcttttgatagtgccttggaactgtcatggcgcctctgggtgtgtcatttagcttgtagattgaagatcaaggtttagttgaattttacytgtctgccatcatggacccattcgatttaatgggtttatgttatgcccttgggctatgtcattctttcaaaggttgtgccctgccctcttctgttctgtt

SEQ ID NO: 110952 - DNA, 201 bp, Bos taurus; identical to SEQ ID NO: 69631

SEQ ID NO: 110953 - DNA, 201 bp, Bos taurus
tgtaacaaagccttcaagttaattttattattacacaagaagcagatgccaagggtttacaagtattttcctaatggtaacacaaactatcccaccccttytggtttttgataggactatatgcaaatttaacatgatagaaatttattcaaaattattataatgaccttataactacccttgtctctatgttattagtga

SEQ ID NO: 110954 - DNA, 201 bp, Bos taurus; identical to SEQ ID NO: 29882

SEQ ID NO: 110955 - DNA, 201 bp, Bos taurus
aatgagacttactaaatgatcatggctgaaattatgtaataggacatagctctgctacagcctcagaggaggagatttctaaatgttctcccttcaaacayaagaggatcttagcacctggaaaccacctctagattcacatttttcgttaagtcatactaattcaggcatgtaagtaggttggcaggaaagaagcttaat

SEQ ID NO: 110956 - DNA, 201 bp, Bos taurus; identical to SEQ ID NO: 29885

SEQ ID NO: 110957 - DNA, 201 bp, Bos taurus; identical to SEQ ID NO: 69638

SEQ ID NO: 110958 - DNA, 201 bp, Bos taurus; identical to SEQ ID NO: 29888

SEQ ID NO: 110959 - DNA, 201 bp, Bos taurus; identical to SEQ ID NO: 69640

SEQ ID NO: 110960 - DNA, 201 bp, Bos taurus; identical to SEQ ID NO: 29891

SEQ ID NO: 110961 - DNA, 201 bp, Bos taurus; identical to SEQ ID NO: 69642

SEQ ID NO: 110962 - DNA, 201 bp, Bos taurus
cggaagtcaacgatggtggcccagtcccaaataggtaatactgacaactggtggtcgtggagagcgagtgtgagcctgttagttttcaaatgaatacacartgttgttcactcatgaaaatccactccatatgcatgataaatttaatctttagactgatctatatgggggtgaatggtaagaattttgaaacgttctcac

SEQ ID NO: 110963 - DNA, 201 bp, Bos taurus; identical to SEQ ID NO: 29892

SEQ ID NO: 110964 - DNA, 201 bp, Bos taurus
tatccaactggtgatttgtgggacgaaatttttcctggaaagatttccttttaaattttaaaagataaaaatttatcaccagtttttagaccattttctamgaagtcaaaagagaaaacgattggctacaatgctaatgctgttaacacgcatgcatgctatacatacatggagtatgtgtgtatttctaacttaaacgat

SEQ ID NO: 110965 - DNA, 201 bp, Bos taurus
aaagtatatgaaatttgtctagatggattatagatctaacccagtttgggaatctttttatgcccatctaaaatggacatatctttgcacataaagtacaygtatacaattgttttctaagagcattgagttgtttaggtaataataagagttatgctgtttttataacgttcaatacagtatatttacaagttccttcaa

SEQ ID NO: 110966 - DNA, 201 bp, Bos taurus
ctctttaaaccattatttatttcaacatttttatacattatgcaccaaatgcgataaataacccttaaaaggagtctgttctttcaagctgttagttttgmgaaaaagagctaagccctaagaacaccaataacaccctcagtaaagaaactatctgattcctcaccttattttttttgtcattttaagagatgtccagta

SEQ ID NO: 110967 - DNA, 201 bp, Bos taurus; identical to SEQ ID NO: 69645

SEQ ID NO: 110968 - DNA, 201 bp, Bos taurus
ggccaaacttaaccacccctctccaggcctgactgtattttatcaccatccttcctttttttaactctcagcttctcaactgtgcaaaaactaggaaagcraaagcccaggccacatggttagataccatcttactccacatagtcactccatatccagaacctctgaaaggaagtatggcattgaaggacagtgcttcag

SEQ ID NO: 110969 - DNA, 201 bp, Bos taurus; identical to SEQ ID NO: 29894

SEQ ID NO: 110970 - DNA, 201 bp, Bos taurus
tgctggagccagaggctgccatccactgggctgaccagtaacgctgtcctcttcgagccgtctcactcctttctccccgagcaccaagcaaagtatggctkttcaattttattgtcttttgtattttcccagacacaagaagaagacggcctccaagctttatttgcgtaaatctgtattttccaggagatcaaagagcct

SEQ ID NO: 110971 - DNA, 201 bp, Bos taurus; identical to SEQ ID NO: 29896

SEQ ID NO: 110972 - DNA, 201 bp, Bos taurus
acacagtgaagaaatctacctgggaaaatgtacgctggggtaatggcactttaagcagcctttcaattctaacatttcacagccacctttttaatctgtaycgaaacactgctcagctgaccgcagggatggagcactgcaaaagatttgctagatttagtgtcttttctctaactgctcttgaaatcttcaagatcaaag

SEQ ID NO: 110973 - DNA, 201 bp, Bos taurus; identical to SEQ ID NO: 69650

SEQ ID NO: 110974 - DNA, 201 bp, Bos taurus; identical to SEQ ID NO: 69651

SEQ ID NO: 110975 - DNA, 201 bp, Bos taurus; identical to SEQ ID NO: 29897

SEQ ID NO: 110976 - DNA, 201 bp, Bos taurus; identical to SEQ ID NO: 29898

SEQ ID NO: 110977 - DNA, 201 bp, Bos taurus; identical to SEQ ID NO: 29899

SEQ ID NO: 110978 - DNA, 201 bp, Bos taurus; identical to SEQ ID NO: 29901

SEQ ID NO: 110979 - DNA, 201 bp, Bos taurus
ttgggctacagtccatagggtcacaaggcatgggacatgactgaagcgacttagcacagcacatttactttactaaggcctccagtccacctgcgaatctytccagatacattctcatagacaaacccagaaacaagagttaatcagccatctgggcctccctcagctcagtgaacatatagtaataaccatcacaggtat

SEQ ID NO: 110980 - DNA, 201 bp, Bos taurus
aaagaaggacttagttactgccacattagcaaaataaaatgccaggtgaaaccccaaatctcatttttacagccaccaagaatttacagttcagaatttaygctgggaagcaagctgtgaacatataaaattcagggcccacatcacaggagagcaccaccgatacgtctcagccccctgctgcacttgggacagtgagag

SEQ ID NO: 110981 - DNA, 201 bp, Bos taurus; identical to SEQ ID NO: 29959

SEQ ID NO: 110982 - DNA, 201 bp, Bos taurus; identical to SEQ ID NO: 29960

SEQ ID NO: 110983 - DNA, 201 bp, Bos taurus
tgtcatgaattgaattttgagttcccccaaattcatatgttgaaattctaacccccatttgagggtattatgaggcggggccttgagagatgaagccctcmtgaatgggcttataccattataagaaacacgagagatgatttttctcttggccatgtgagggtataataagaagatgctcctctgcaaaccaagaagagt

SEQ ID NO: 110984 - DNA, 201 bp, Bos taurus
tgtctgggtaagcagttttccagacaaagggaatggccaagctaaggaactgccactggatttcccttccccacattctggaacgtcaccccatgagcacrtcaaaggccaggaggaaccagaggcagggaggccagagcaggccaaccttagggtgatggcaagagagaaacctaatagacccagaggttttgcttcttt

SEQ ID NO: 110985 - DNA, 201 bp, Bos taurus
ctgccttaacacatcagaacaaatatttgttagactcggggccagtttcctcctcagaggcagacacaaaccgtctaaataatgaaatgcattagagtaaygggaaaagttcattgtctatgctatttttcacatagttttgtgagtgcagttgttgggactgatctggttttcaaagcagcctgtacatgcagattcatt

SEQ ID NO: 110986 - DNA, 201 bp, Bos taurus; identical to SEQ ID NO: 69710

SEQ ID NO: 110987 - DNA, 201 bp, Bos taurus; identical to SEQ ID NO: 29963

SEQ ID NO: 110988 - DNA, 201 bp, Bos taurus; identical to SEQ ID NO: 29964

SEQ ID NO: 110989 - DNA, 201 bp, Bos taurus; identical to SEQ ID NO: 29965

SEQ ID NO: 110990 - DNA, 201 bp, Bos taurus; identical to SEQ ID NO: 29966

SEQ ID NO: 110991 - DNA, 201 bp, Bos taurus
ctaactggtcaagccagaaagccctttgtggtaaagcagaggtggtggtagagatctctgatttctaaaagcttgtttttaacctctaacagccaagagakagaacctacaaacctgtgggagctattgaagagcaggtagtaaaactgttggaagttatcatcacctcccattataacatgcctcttatttgtacagtgc

SEQ ID NO: 110992 - DNA, 201 bp, Bos taurus; identical to SEQ ID NO: 29969

SEQ ID NO: 110993 - DNA, 201 bp, Bos taurus; identical to SEQ ID NO: 29971

SEQ ID NO: 110994 - DNA, 201 bp, Bos taurus; identical to SEQ ID NO: 29972

SEQ ID NO: 110995 - DNA, 201 bp, Bos taurus; identical to SEQ ID NO: 29974

SEQ ID NO: 110996 - DNA, 201 bp, Bos taurus
tcagaactcttgttttcttcactttagaaatgctgtttggatctcaagactgtttctgttcaggccaccctgagtattaaataaagtcattggtggttgcwggactgatttaaaaaaatattttactgttactttctgacaatttaaacttcagtaggaatattttagaatttcatccctgtgggcttcttttcccagaga

SEQ ID NO: 110997 - DNA, 201 bp, Bos taurus; identical to SEQ ID NO: 69720

SEQ ID NO: 110998 - DNA, 201 bp, Bos taurus; identical to SEQ ID NO: 69723

SEQ ID NO: 110999 - DNA, 201 bp, Bos taurus; identical to SEQ ID NO: 29980

SEQ ID NO: 111000 - DNA, 201 bp, Bos taurus; identical to SEQ ID NO: 29981

SEQ ID NO: 111001 - DNA, 201 bp, Bos taurus
ccatcgatgtgggtagaattactttatactcaccaggacaggccctgtttctccacttgcatctgggctcagcgccactgacagaggtactgagccaaaaygcctgcacgatccaggccctgccctgcccagccccaagatctgcctagcaacgcatctctctgggcctcagtttcctcactggcatggtggggctgcttc

SEQ ID NO: 111002 - DNA, 201 bp, Bos taurus; identical to SEQ ID NO: 69728

SEQ ID NO: 111003 - DNA, 201 bp, Bos taurus; identical to SEQ ID NO: 69729

SEQ ID NO: 111004 - DNA, 201 bp, Bos taurus; identical to SEQ ID NO: 29983

SEQ ID NO: 111005 - DNA, 201 bp, Bos taurus; identical to SEQ ID NO: 29984

SEQ ID NO: 111006 - DNA, 201 bp, Bos taurus; identical to SEQ ID NO: 69731

SEQ ID NO: 111007 - DNA, 201 bp, Bos taurus; identical to SEQ ID NO: 29990

SEQ ID NO: 111008 - DNA, 201 bp, Bos taurus; identical to SEQ ID NO: 29991

SEQ ID NO: 111009 - DNA, 201 bp, Bos taurus
aactgtgggtctcaactgagatgacaaataggtatggaaggaggaaggaggtgagaaaacaagatgcatgggtattcccaaagagccaatggagtagagcrgttccaggtgaaaataagacctaaggtgtattcgtgggtagataacttaggtgaattagacctctttggcattagaaagttcaagaatgggttaagtaca

SEQ ID NO: 111010 - DNA, 201 bp, Bos taurus; identical to SEQ ID NO: 29993

SEQ ID NO: 111011 - DNA, 201 bp, Bos taurus; identical to SEQ ID NO: 29994

SEQ ID NO: 111012 - DNA, 201 bp, Bos taurus
gcaatacagaagtggtttgctgaatataagataaagctttcctttagatgaataaagagagcttttaaaaatcaatgaagtgaaaaggccggatgattaaygaaatcggcatgatactgaaaatgaaatcttgaactatctgttgttgtttagttgctaagttgtgtccaactcttttgcaacccatggtctgtggcccgc

SEQ ID NO: 111013 - DNA, 201 bp, Bos taurus; identical to SEQ ID NO: 69740

SEQ ID NO: 111014 - DNA, 201 bp, Bos taurus; identical to SEQ ID NO: 69741

SEQ ID NO: 111015 - DNA, 201 bp, Bos taurus
agcatcttgtggtatatgggccatcctggattactatattgagtattaatcacaaactttcacttttcctataggctactaaatcacttttatttggatcwagggcctgcaagaaactcaccaagtctctacatatcaatatgaggacatctgctgtgactaacagttgaaggcagctgacccccttgtgtaaactgtaag

SEQ ID NO: 111016 - DNA, 201 bp, Bos taurus
tgttccagggcctagctggaggaagacagcatcctggccaccggcctgtgcgtagctgtgttagacttgttgctgcctgatttcccgttgcattgctctcrtggggacgtgctctgctggccctctttgatgtcatctgctgttctccgcaacacttgccagctgtcctgagacccacaggtcacaatgtcctgcccgcca

SEQ ID NO: 111017 - DNA, 201 bp, Bos taurus
ggtggccaaagtgttattcagcctgctctaacctgagtgtgggctgtatgcctttgcaatcgtgctatgcagatgctgcaaaactctgctccactggtgcrgcgtggactaaaactgtttggcctgtgcagtattattgttttataatggtgaaatatttcaaatgtatggaacagtaggatcactaatataatagtgata

SEQ ID NO: 111018 - DNA, 201 bp, Bos taurus
cagagcttttgcattgagaggggagtgctagcttgctaccgaccactcagagaaaagatgagggatgggctagataagttttcttctgtagctgagggtayctttctgccagacattgggtttagacagtggaagacagaggcctacaaacaactctgtgatgtgagagggagggaagtaaaaggagccataggaaaagcc

SEQ ID NO: 111019 - DNA, 201 bp, Bos taurus
atcacactgcccagaatggctcagaatttaaaactcccaaattgtttatttctggaattttccatttaatattttctgacaatgattgaccttgggtaaakaccatcacagagagggaaaccacaaaaaaggggggaatggctgtaacggatttttttttttaagtggcaagcagtcatatttacagagtgattcttttat

SEQ ID NO: 111020 - DNA, 201 bp, Bos taurus
caaagccttttcgtctcagtcaaaatcctaatggtggcccttacaagagctagctcctcattatcttgttgacctcatttcctacttctccgtctccctcmctctcctgcagtcagaagggccttcttgccattgtgcctctgcctcagggcctttgcgtgggctgttcctcttcctgggatgctcttctcaggacctcac

SEQ ID NO: 111021 - DNA, 201 bp, Bos taurus
tgagtttggagggaggaagtgggcatgtgtggcccagccccttgccctccctttctgagggagctggactgctcatagagaggtgctgttggtcagtcacygtggccctgcctgggggaggtcggaatgcgctggacgtgcttgctggggacaggataggtaagtcttgtctaaatccaggggtcgttcatcaaggaaggc

SEQ ID NO: 111022 - DNA, 201 bp, Bos taurus
ttatatgtcagattcatagacgtacaattagtagatcaaggggtatgactactttgaaattttggaaacattgccaaacaaccctgtcaagagagagtgtrttcccaatagcagagaaagtcgaaggcactgtatccttgtgagcatttcgtgtttcctatgatcattttgtagtctttgctaatttaatttgggagatta

SEQ ID NO: 111023 - DNA, 201 bp, Bos taurus
gccttcccttctggtccagcttcctaggttgttgccactttggactctatttgagcactgtagctagtaatacctggtaaagtgaagtttctgggaaacgytggccattcagtggctctgttgagagagcatactcatcacttgatcaagcgtcacgcacacaggattttttcactctgctttattgactggcgtatcctt

SEQ ID NO: 111024 - DNA, 201 bp, Bos taurus
ctgtgtttaggtggcaattctgttctgttccctattgcttgtcatcttgaattgcaggcctctgaaactggcactggttgcctgtctcccattcagcaccrtgagcactctgcttatatgtaaccccctttcatcctaaaggctgcacatggtgttccttccaggaggtcctgctgtactcttttctccatcctactgggc

SEQ ID NO: 111025 - DNA, 201 bp, Bos taurus; identical to SEQ ID NO: 69742

SEQ ID NO: 111026 - DNA, 201 bp, Bos taurus
taaagctaagaagaatcttttttaaagatctctttactctctcttcattttcattcttaatattaaagatggattctctctggggtttgaaattccacaawtaatatccttagaagattcattgtgtattcaaagataagcagagaaaaatacagctctattgaatagaccccagttcttgtctttgaccatgttatgggc

SEQ ID NO: 111027 - DNA, 201 bp, Bos taurus
ggtatgatcaccccaatttctccatagacaacttcaacatttttctttctcttgcctctatcattctcagagatagaagcatgaagctgcaagtcatgcartgcatctatacggccaggaatgccaataaatggacaatgatgtaaccatggatgtcatggattttgattcaatcccaatctgtatgtcacttacaaatgt

SEQ ID NO: 111028 - DNA, 201 bp, Bos taurus
aattgggttcaatcatacacatcaaatcatactctagtcatgccacatcaggaaatatatgcattattttactcagtcatggaattttagtcaatcaactraaccagaatattatttacaacaatactgtcttgaatgaaaagagatgtatagaaattcacaatacacccagcaaaagcagacaacctacaatttattgag

SEQ ID NO: 111029 - DNA, 201 bp, Bos taurus
agaggaaggcaaagtcgagctgcaaattaaattcattctttgaagacttattagtaggcaaagaaagtcaatgagcaatgtagaaaatgatttaagcccgycgctgccattttatctaggggcaagctctgtcaaagactatttagtgcttcgccctattaccacaaacttatcaccatctgttccttttgtacatccctc

SEQ ID NO: 111030 - DNA, 201 bp, Bos taurus; identical to SEQ ID NO: 69745

SEQ ID NO: 111031 - DNA, 201 bp, Bos taurus; identical to SEQ ID NO: 69746

SEQ ID NO: 111032 - DNA, 201 bp, Bos taurus; identical to SEQ ID NO: 69747

SEQ ID NO: 111033 - DNA, 201 bp, Bos taurus
ggaatatagccaacattttgtaataacggtaaatggaagataacctttaaaaattaaataattttaaaaaattactaataattgactgaaaactaaagatrctattgtcataaaatacttgcagaaaatagggaataataggacctgtaagtgttctaatggaaaacagagggtggaggaacatgttataaggctacagtg

SEQ ID NO: 111034 - DNA, 201 bp, Bos taurus; identical to SEQ ID NO: 69751

SEQ ID NO: 111035 - DNA, 201 bp, Bos taurus
gagttaaggcacatggcagaatacaagatagccataaaaataattgtgtttctatacaccaacaagattacttctcagacttcccaggaagtgaggacaargagactgagctatgatgtctccttatgactgcccttcctttagggaaggacctgcccacaggatgctgttccctgacacaaaaacacaaaggaaagcaaa

SEQ ID NO: 111036 - DNA, 201 bp, Bos taurus; identical to SEQ ID NO: 69754

SEQ ID NO: 111037 - DNA, 201 bp, Bos taurus; identical to SEQ ID NO: 69755

SEQ ID NO: 111038 - DNA, 201 bp, Bos taurus; identical to SEQ ID NO: 69756

SEQ ID NO: 111039 - DNA, 201 bp, Bos taurus; identical to SEQ ID NO: 69757

SEQ ID NO: 111040 - DNA, 201 bp, Bos taurus; identical to SEQ ID NO: 69758

SEQ ID NO: 111041 - DNA, 201 bp, Bos taurus; identical to SEQ ID NO: 69759

SEQ ID NO: 111042 - DNA, 201 bp, Bos taurus; identical to SEQ ID NO: 29995

SEQ ID NO: 111043 - DNA, 201 bp, Bos taurus
aagtcaacgtttattgaccaagtgctaggccagtgttatttcaacatgttacctcttgagcgatagcaagggcagcatcacctgggaatgtgttaggaatrcagattctcaggcctgttccagacttcctgagtcagaacctctgggatgggggcggggtcatttgtcttttaacaagcgctccaggtgcctgtgaagctg

SEQ ID NO: 111044 - DNA, 201 bp, Bos taurus; identical to SEQ ID NO: 29997

SEQ ID NO: 111045 - DNA, 201 bp, Bos taurus; identical to SEQ ID NO: 30000

SEQ ID NO: 111046 - DNA, 201 bp, Bos taurus; identical to SEQ ID NO: 30001

SEQ ID NO: 111047 - DNA, 201 bp, Bos taurus
tctacaatctaggctatgatttgaagatgtaatttcttgctttgtgtagttattcttaactctttgtagcatgctttaactcaagttgtaagcaagtttcrtataccaattaggctttgtgccagctaagttcaactgaaaccagaccttgaatccctaaaattgtaaaggtttattgtgacaaatacagaaacaagatat

SEQ ID NO: 111048 - DNA, 201 bp, Bos taurus; identical to SEQ ID NO: 30003

SEQ ID NO: 111049 - DNA, 201 bp, Bos taurus
gagtttttaaatgaaatgacctcttgcattctatatttgaaagtttccttatgtaattccatgtatgtgatttataaaggtatggttagaacctataagayggttagattttagagttctctatccatgcacatagatgcataagcccacacatgacaggtcacatgatttccatcccaccatacgactgtagcggtttca

SEQ ID NO: 111050 - DNA, 201 bp, Bos taurus
tataatatgaaattacattttgatgattagaagcttatttgccttcattggaatgatgatctttcttcttgtttgaatcctaaagcaagaccttttccaayatagcaaataatttttcataaatcttacttttgctataattaaacactagagaagatcatagtaaacttctagacatgagacatgtgaagtaggtacagg

SEQ ID NO: 111051 - DNA, 201 bp, Bos taurus
aagtgaagtgatatagagatgaaccatttctacaatttcacagtcactgatattgacaaaattaaaattgacaccaacaaagcaaaacatctgttattggygacatatttaaacacacagtagacaacagaataatagctgtgtgaaagaagagttacagggcacatgtccttagttttcagttctttgacttgaggtttc

SEQ ID NO: 111052 - DNA, 201 bp, Bos taurus; identical to SEQ ID NO: 69763

SEQ ID NO: 111053 - DNA, 201 bp, Bos taurus; identical to SEQ ID NO: 69764

SEQ ID NO: 111054 - DNA, 201 bp, Bos taurus
ccctttgggaaagtgtagcattttccttcaaatgttcccccaattcagtttcttttccgatagttaatcggaacacagcagtgctctcaagagaccatgamcattcagaaaagaatcgggaaggaaaagtctgttttatagctaatgaatgagagttgtacagttttcttgatttgagagtagaaaaatcatttttacccc

SEQ ID NO: 111055 - DNA, 201 bp, Bos taurus
atggttttcagcttgaccctgtcactttcactagtcaattctgtttatgcactaatttttttttcacagacaataaaattcagtgatgtacgttgctgttrgaagtgtagtttttgctgaaggcaatcagacttactgactctaactaaaataaataattggagatttctaatcactaaccaaagcatttttcccatagta

SEQ ID NO: 111056 - DNA, 201 bp, Bos taurus; identical to SEQ ID NO: 69767

SEQ ID NO: 111057 - DNA, 201 bp, Bos taurus; identical to SEQ ID NO: 30004

SEQ ID NO: 111058 - DNA, 201 bp, Bos taurus
ccagttacttttttaacccacaattgcgcttccaaatggtagatttacaccatcctctgcaccagcttttaataccgtttccatagaaggatgtagggccrtatgatgtaattgaaagatactggactgggaatccacaaacctagtttttaatagggtcctgctgctgagtgatgtgatattagcctattgcccactttc

SEQ ID NO: 111059 - DNA, 201 bp, Bos taurus
ggtgggcagagccagctttcaaaagcaatagaagcctagatcttactgtttcccaactgtcattctcctgccaaggcccttttaaatagggtttggggtcygcctttgtattacatatgcataacttccattagtgttaatcacatgctccattttagagctgttttggcccctccggttaaatgggcgtttaaacagttt

SEQ ID NO: 111060 - DNA, 201 bp, Bos taurus
aaaaataaacgttgatattttccaataagttgcttctatttcttatagcaaaaatgctctatgttacaaagtatgaaaaaagaaaataagaattttaggcrctgttcattaattgcatgcatttatatactgcatatttacttcttaaatacatgtaaattctaaagtaagtcattaagcattcatgtgatttaaatagtg

SEQ ID NO: 111061 - DNA, 201 bp, Bos taurus
catgtttttccatacactctactacttataagaaagaaaaagaatgtgtgagtttctccctgaatccttgaagctcttttgaaatgtgatttaatagaaarttacattttacttatcatgtgatatttcatgtttaagggccaagaatattctgtatgtataagagaaaagcatagccagagtgtgttgaaatatgagtca

SEQ ID NO: 111062 - DNA, 201 bp, Bos taurus
ttttcttacatttgtgaatttagtgccaccaaagaccaacagcactggccaagggctccgaaaaatagacaccatgaacacttcctatatctttttttttwttattattacgttagatttggccatcttttaaaagctgatcattatgttggtaaaattataccaaaatataaattggtgtacttatttgtacaaagaaaa

SEQ ID NO: 111063 - DNA, 201 bp, Bos taurus; identical to SEQ ID NO: 69774

SEQ ID NO: 111064 - DNA, 201 bp, Bos taurus; identical to SEQ ID NO: 69775

SEQ ID NO: 111065 - DNA, 201 bp, Bos taurus; identical to SEQ ID NO: 30012

SEQ ID NO: 111066 - DNA, 201 bp, Bos taurus; identical to SEQ ID NO: 30013

SEQ ID NO: 111067 - DNA, 201 bp, Bos taurus
ataattctgatgagtgtttggatgcagtaaggcaacatttacagtctgagaagacccaacaaagaagagtgggcaagtgctaagcaaaagatttatttctygaaacagaggtgatgacagcactgttcttggcttatttcctctattagctgctagtccttaatacaatcatgatgtttttaccccaagtttgttctctta

SEQ ID NO: 111068 - DNA, 201 bp, Bos taurus
ggtgataactttatgttatatagaaccatgtctttaagaatgccttctttcatcttaggttacatgtccatgttatctgagcacatgaaatccagtgcttmtgttttatattcctgaatagatagtattgtcattcccttgtgaatacatcagtatgtcccacaagttcataatctccttgaaggcaagaattgcattact

SEQ ID NO: 111069 - DNA, 201 bp, Bos taurus
gcaacctcttgtatcagagtagcaccttcatagcctggaaccacacagcctgaaagcataaaagctggcctctaaccagggaaaaatcaactcccatcacratagacagaataaaatacaatgcactttgttttaaccagagcttccgcaagtttaaagcgtggagggagcttgtaaacccacattcctataagtaattga

SEQ ID NO: 111070 - DNA, 201 bp, Bos taurus; identical to SEQ ID NO: 30015

SEQ ID NO: 111071 - DNA, 201 bp, Bos taurus
gctttcttttactacatatttgatgtaatgaatagccactaaactagcatgagtaattttatataatactgtttttatccacggccttgattataaagttmctttataacttgctttcgtttcttactttgaattggcttgccctcaataacaacataaggttctaggtgttcactgcatttggaaatcagaataccatca

SEQ ID NO: 111072 - DNA, 201 bp, Bos taurus; identical to SEQ ID NO: 30019

SEQ ID NO: 111073 - DNA, 201 bp, Bos taurus; identical to SEQ ID NO: 30020

SEQ ID NO: 111074 - DNA, 201 bp, Bos taurus
acttagtgaaaaattgggacaaattaaatacctgcctttaaatatctatccctaattgtcaaacttaatgatctattcatagaagtatgcataaactgtgraagtttctaattttcatacatactctatgcatttcaaaattgcatgttttgttctgtgcctttttgttgttgttgttctgtgtgatactcaggttccagg

SEQ ID NO: 111075 - DNA, 201 bp, Bos taurus; identical to SEQ ID NO: 30021

SEQ ID NO: 111076 - DNA, 201 bp, Bos taurus
attaatgcaggtgaaatcctatcacagagaactccacaggaaaccagtattaatgaaaactcccaatggatcaaagtggagacttctcagaagctctaaartataactccttctttaaaaatcttaaactgcagcatccagagggaatatctctaataaagaaggcctcaagtattttaaggtgtttatctttgaaggggc

SEQ ID NO: 111077 - DNA, 201 bp, Bos taurus; identical to SEQ ID NO: 30023

SEQ ID NO: 111078 - DNA, 201 bp, Bos taurus; identical to SEQ ID NO: 30025

SEQ ID NO: 111079 - DNA, 201 bp, Bos taurus; identical to SEQ ID NO: 30027

SEQ ID NO: 111080 - DNA, 201 bp, Bos taurus
gtttagttcctctctctcatacagggtacaatcattctctgacattcttgataccctttattctgaatatccacagaatcctaatttatgtatctattcamgtttggaaatacagataagccttttagtctcatttttgtaaaataactccactttgatctgtaaagaaatatctctattttaagcaggcaggctaattgg

SEQ ID NO: 111081 - DNA, 201 bp, Bos taurus
tgacaatatcagataatgatgaggaagtagaacaatcgaaactcttcacacgttcctggtgggaagtagtccagcaatatattttaaaagggatcatgacyctaagacacaaactattttataaaaagttatgtacaagaatgttgataatagatttttaaaaataatttcccgaaattggaaacgactcattgaccatca

SEQ ID NO: 111082 - DNA, 201 bp, Bos taurus
gtcagggcctaaagcctccatgggccaattcttcctcattcctcccttctcactcactcctctcacttcctctactgctccttccggtcttcttctctaartacgtgtccatcccttaatgcaacttaaaactatttcatatgatcatcatctagggtttattttagctataattaattaaaagccaaactaacaatgact

SEQ ID NO: 111083 - DNA, 201 bp, Bos taurus
ggatttcatttattacctatttcttttgttatctatttcctttcaggaaaggattaacaaaccggcataggtacagcatataataactcctgaaaataacrtactcttattgcagaggacttttatgaaaggcttttaggttgtatatattgttgagctccaatttattgttttacttgtgtaagacttctgagtggtaaa

SEQ ID NO: 111084 - DNA, 201 bp, Bos taurus
caatcagtgcctccctgctctcttggtctggacaccagtgcattgaattgcatggtcaggcagatataacagctcaggaaccacaagtaccaattcctgamgtgttctgaattctagcttaggattgtgtgaagatagaaggacttaatgaaaatgactaaaccacatgtagtgtgagaattatgttccttttacttccca

SEQ ID NO: 111085 - DNA, 201 bp, Bos taurus; identical to SEQ ID NO: 30034

SEQ ID NO: 111086 - DNA, 201 bp, Bos taurus
gccccatggttggggagcatgagtgaggaggggacttggacacaatccatacaaagagctacaatccatagatttgggctccattgcaactctccgcctaracctcttgttctggccggggccctgtatcctcagcagatttgcctcttccctgggtgcctatgagtgctccccctcagtcgggtcactactgaattacac

SEQ ID NO: 111087 - DNA, 201 bp, Bos taurus; identical to SEQ ID NO: 30037

SEQ ID NO: 111088 - DNA, 201 bp, Bos taurus; identical to SEQ ID NO: 30038

SEQ ID NO: 111089 - DNA, 201 bp, Bos taurus; identical to SEQ ID NO: 30039

SEQ ID NO: 111090 - DNA, 201 bp, Bos taurus; identical to SEQ ID NO: 30040

SEQ ID NO: 111091 - DNA, 201 bp, Bos taurus
aacaatgttcactgtctggcccatctgaaaggcagggtgctgaaaatcattaatatactgtaatttcacatgagcccggcatgggtcacagaggatggtayggcctgttgtgaaagactccattacttcacagggagttttggcttggagaccctggctctgagaaaaataacccactggttggcagctctagcctaacag

SEQ ID NO: 111092 - DNA, 201 bp, Bos taurus; identical to SEQ ID NO: 30044

SEQ ID NO: 111093 - DNA, 201 bp, Bos taurus; identical to SEQ ID NO: 30045

SEQ ID NO: 111094 - DNA, 201 bp, Bos taurus
tagacatttcttcaaagaatacatacagatggccaacaggcacatgaaaagaagctcaaattgcgaattattagagaaacgcaaatcaaaatcacaatgargtatcaccataaggccatcattttaaaaatctacaaataaatgctggagagggtgtgaagagaaccctcatatatctgctgttgggaacggaaatggtgc

SEQ ID NO: 111095 - DNA, 201 bp, Bos taurus
gcagagtcctttactcctgactccatgggggagggcctttaagccagatgcatggaaagcaggttcagcgaagacagtgattcaaaactcacacagacacrtctccaaagtcctgaggccagctccctggaggaaatccggcagcctctgccatcgaaagagtgtggtttccagggcacgtgaggctgggagcagctgggc

SEQ ID NO: 111096 - DNA, 201 bp, Bos taurus
agatttgaagttctcctaaaataaatttcaggcaaatatgacctcattatttttaacttcagagttctctatctggttcatagaggtggcagtaagctgaycagaacactagaggaagagaaaataagagcaagaactgtccccctatcctgttctctgaccatggcagccagccctttccatctctgggtcactgtttcc

SEQ ID NO: 111097 - DNA, 201 bp, Bos taurus
agcctggtgggctgctgtctatggggtcgcacagagttggacatgactgaagcgacttagcagcagcagcaagcatacttatagtgtctagctgtcaggayaggtgatgcagacatatgtacagggaactagtagagctgcagcaagtcttcagagcagcagtctcctagtgagggttgagcctcttctctggccctccca

SEQ ID NO: 111098 - DNA, 201 bp, Bos taurus
aatattttaatgtgtggagctccctgtctgttccgcacccatgaaatcaggccatacatgtagaacgtgtatgcagatagccatttacagattgagcaccraatgatggaacggcccgtcgatacctcatctgagttggtcaaaaggcggaaataattctcctattatttctgtcactgtcagggttcagttgaatctcta

SEQ ID NO: 111099 - DNA, 201 bp, Bos taurus; identical to SEQ ID NO: 30047

SEQ ID NO: 111100 - DNA, 201 bp, Bos taurus; identical to SEQ ID NO: 30048

SEQ ID NO: 111101 - DNA, 201 bp, Bos taurus; identical to SEQ ID NO: 30049

SEQ ID NO: 111102 - DNA, 201 bp, Bos taurus; identical to SEQ ID NO: 69815

SEQ ID NO: 111103 - DNA, 201 bp, Bos taurus; identical to SEQ ID NO: 30050

SEQ ID NO: 111104 - DNA, 201 bp, Bos taurus; identical to SEQ ID NO: 30051

SEQ ID NO: 111105 - DNA, 201 bp, Bos taurus; identical to SEQ ID NO: 30052

SEQ ID NO: 111106 - DNA, 201 bp, Bos taurus; identical to SEQ ID NO: 30053

SEQ ID NO: 111107 - DNA, 201 bp, Bos taurus; identical to SEQ ID NO: 30054

SEQ ID NO: 111108 - DNA, 201 bp, Bos taurus; identical to SEQ ID NO: 30055

SEQ ID NO: 111109 - DNA, 201 bp, Bos taurus
agtgatgcaccccaatccactacttgttaacaatggagtgtaaaaaaggagggaggcagaggtggggaaggaggaaggacttaccaaatgaggtttggggkattatctgtggatttcatttaaacattctctatctcaccctcaatataatggaaaaagtaaagttgggctttattcacgtatatgaatatgtgaaattca

SEQ ID NO: 111110 - DNA, 201 bp, Bos taurus
ttctgaataaatacaagaaaatgcctctgcctgaaactttggtttaattaaaaatcatgacgatctgtttattacaagaggccctgggctgtatatgtggrcatctgagcatcagtggctttctttttttaaatttggatataaagtttcaaatgacacaaatcaataagcatttgtggtcaggccataaaacaacgattt

SEQ ID NO: 111111 - DNA, 201 bp, Bos taurus
aacaataactacagccaaggtggatttttttttttttaattgtgtcaggggagggatcttggagaaagactgagtctagaggggaggacatgttcaaatgrgtggagggaggtggaagggagttatcatcagcagagatcagcttaagcaaaagagtgcagatgactgaaacagcccaatttatgtagggtctgcttctca

SEQ ID NO: 111112 - DNA, 201 bp, Bos taurus; identical to SEQ ID NO: 30057

SEQ ID NO: 111113 - DNA, 201 bp, Bos taurus
atctagcgatgagattctaaactgaccttcccgcagtttacttcccgcagtaaggttagaaggcaagtgtttggctatttcatagcacttcaacttgctartcaatgaaataatagagtacttctgatatccattttagtgttaaataaattatccatacaaggtaacacaaaacataaaatgaacatccatttttttgtt

SEQ ID NO: 111114 - DNA, 201 bp, Bos taurus; identical to SEQ ID NO: 69825

SEQ ID NO: 111115 - DNA, 201 bp, Bos taurus; identical to SEQ ID NO: 69826

SEQ ID NO: 111116 - DNA, 201 bp, Bos taurus; identical to SEQ ID NO: 69827

SEQ ID NO: 111117 - DNA, 201 bp, Bos taurus
agggatggcctctagaaactgaagacatcaaggaaattaattctcttctagagcttccagacagaacttaagccctggtaacatattgattttagcccaamgaggcctatgtcaaacttctacctatagaccatagtattatacatttgtgctactgaggcttcaagtttgtagtgtatgtggatgtgtgccgagtcactt

SEQ ID NO: 111118 - DNA, 201 bp, Bos taurus
aagttttgccttctgctagtcagtcttttctctcaattaaaatctctatgaattttactctatataatggaagtatctctttcccttcctcccacctcttytaatgcagatgtcactcagaaggtagaccctagaaatagatatctcacttgactgctgatgggtttcctcctcattacatagaatgcagtggctactcca

SEQ ID NO: 111119 - DNA, 201 bp, Bos taurus
gtatagttaggagcataacaggcatgtgaaagctttaaatttgcattacaaagcactacagaaatgtagggaagtaatatccttgttaataactctcatgmacattctcctaagtgtagattttaaagagggcagagagctgctaattctgctttaaagaaaccacagcctcaggacatatacatgttaagaatgagcaaa

SEQ ID NO: 111120 - DNA, 201 bp, Bos taurus; identical to SEQ ID NO: 30060

SEQ ID NO: 111121 - DNA, 201 bp, Bos taurus
gatatgtaatttacattgcaattaagaaatatatctatagaatactatctgaccctgtataataaatttatctttctttggatttgcaattgaaaaaaaawaattaactgatgcatgtacaagccactccaattgctgggaaacactgcaagttagaaacagcaagcagtgattctcccttgaaggtttctgaaagaatat

SEQ ID NO: 111122 - DNA, 201 bp, Bos taurus
agagatcttttatatattatgtgctcatatgaatgataatacactaagaccctgataaataggcaaaaggagagattacaaaagaggaaatataactattwaaaacataaagcaaaatattcaaaatttttattaatcaaaggatataaactaaaatattgagataggattaatcacctgttatttaaaatttaataatga

SEQ ID NO: 111123 - DNA, 201 bp, Bos taurus
ttcaacacatatttttcaaggactataaagtgacaggaaggtttctaagcactgtaacactggtctctgaactactttggctatagagataggtaataaawataaaacaatatagcacacagtaagaattgattggccattgtatcaaaactgcaagaaatacacttttggcagagaaagagtacccatttagttcaagac

SEQ ID NO: 111124 - DNA, 201 bp, Bos taurus; identical to SEQ ID NO: 30063

SEQ ID NO: 111125 - DNA, 201 bp, Bos taurus
tgatagaatcacatttcctccctgtggaacatggaaatacagtgagatagtgttcctatttaccatctttccccttggctatgtccacattagagaaacayagattgttacaatttgattttatccttttcaaagctatattgatgttttcatataagctactgaacacaacacaccacatcaaagaaagaaaaattgact

SEQ ID NO: 111126 - DNA, 201 bp, Bos taurus
tctttaatcttatatattccacagttatgcttctccaaccaagagttttcatttttctctattatatctttcttaccagtaccactagaacattttcttcrgaaagttgtgttactgtttaatataaacaagaacaaaacaggccttgcaatggtgaagatggtacattttcttccttataagtaagaatgtggtatcact

SEQ ID NO: 111127 - DNA, 201 bp, Bos taurus; identical to SEQ ID NO: 30064

SEQ ID NO: 111128 - DNA, 201 bp, Bos taurus; identical to SEQ ID NO: 30065

SEQ ID NO: 111129 - DNA, 201 bp, Bos taurus; identical to SEQ ID NO: 69829

SEQ ID NO: 111130 - DNA, 201 bp, Bos taurus; identical to SEQ ID NO: 30076

SEQ ID NO: 111131 - DNA, 201 bp, Bos taurus; identical to SEQ ID NO: 30077

SEQ ID NO: 111132 - DNA, 201 bp, Bos taurus; identical to SEQ ID NO: 30078

SEQ ID NO: 111133 - DNA, 201 bp, Bos taurus; identical to SEQ ID NO: 30079

SEQ ID NO: 111134 - DNA, 201 bp, Bos taurus; identical to SEQ ID NO: 30080

SEQ ID NO: 111135 - DNA, 201 bp, Bos taurus; identical to SEQ ID NO: 30081

SEQ ID NO: 111136 - DNA, 201 bp, Bos taurus; identical to SEQ ID NO: 30082

SEQ ID NO: 111137 - DNA, 201 bp, Bos taurus; identical to SEQ ID NO: 30083

SEQ ID NO: 111138 - DNA, 201 bp, Bos taurus; identical to SEQ ID NO: 30084

SEQ ID NO: 111139 - DNA, 201 bp, Bos taurus; identical to SEQ ID NO: 30085

SEQ ID NO: 111140 - DNA, 201 bp, Bos taurus; identical to SEQ ID NO: 30086

SEQ ID NO: 111141 - DNA, 201 bp, Bos taurus; identical to SEQ ID NO: 30087

SEQ ID NO: 111142 - DNA, 201 bp, Bos taurus; identical to SEQ ID NO: 30088

SEQ ID NO: 111143 - DNA, 201 bp, Bos taurus; identical to SEQ ID NO: 30089

SEQ ID NO: 111144 - DNA, 201 bp, Bos taurus
ttcaccaagtttaccagggggaagggggttttatatataaatacattgtatttataaatacattgtaaatacatcgtattcagtgtttggccaaatatttyctctagcttatgtgaaaacaaaattcatctctattaagtgcaagttttgtctgtgctgtgatttctgtcatcttcctccctattctctaacacaaggcct

SEQ ID NO: 111145 - DNA, 201 bp, Bos taurus
caagggtgcttggcatatgtagaaaagtacttttagtatttggcatacaaatactgtcttcagtgcagtagccattgaaacacatatatctcatctgttarttcactttaggcctcttaataacaatggggaaattattcatatcacaaacattaatttctagctatactaattgagagtatttgtgtcaaattggtaaga

SEQ ID NO: 111146 - DNA, 201 bp, Bos taurus
aggtcatttcttcacagctgaaacacagtgtagctagaaacactgattggttctgttctgatctggtcttctcagctctcctgtctttctctgggctgatytgggtaatttcaaaactatatttttccactgatttccacgaaaaattctaacacagacagtaactaattagtttgacctaattttatgattgacccattc

SEQ ID NO: 111147 - DNA, 201 bp, Bos taurus
atggtggctgccagaggccggggaaggggtgagtgaggagttgttgatcagtgagtataaagtttcagttattcaggatgaataagttctagagatctaayggcaacattgggcccagagatgacaacactattgtactgaactatctgctgtggtttcatatattaactgttctcataaaattaaaaaaaatatattaat

SEQ ID NO: 111148 - DNA, 201 bp, Bos taurus
tttttacacattgggtcttccattccaatctatactcattatatggggcttcatttttacaatttttctttaaaaatttgatctaaataatgttttgtatmtttagtatacaggaataaaacacaacttttggtaggttgcaatggttttgattctaatatagttgttattattttaaagaattttatttaatttgcttgt

SEQ ID NO: 111149 - DNA, 201 bp, Bos taurus; identical to SEQ ID NO: 30092

SEQ ID NO: 111150 - DNA, 201 bp, Bos taurus; identical to SEQ ID NO: 30093

SEQ ID NO: 111151 - DNA, 201 bp, Bos taurus
accactgcagtacagatactgtcctagtgtatcacaggagaaggcaagggaaagatgggcaggatatagaaatgcatattgtacacattatagtctaggtrtacagatgaactaaacatatttggaaatcttactaaatgccaacattacatattaactcaacagtacaagaatggctgcagagcaattcaaaataaaatt

SEQ ID NO: 111152 - DNA, 201 bp, Bos taurus
cttctccactgcacaatttctcaggccatcagatacttttacttcattactccatgtcagttcttttcccttttaaatcaagttttatgttgctgccagayatatgcctataattatcctgggtctttataatgagaggccaaggaataaaaatcttcagttagttgtccaagtctaaataattcaacctaaacttcaact

SEQ ID NO: 111153 - DNA, 201 bp, Bos taurus
tccatactgtcgccaaagtcaactggcaaaaacacagacctgatccctgctatataaaaattcttccattggctgggaaaggccctaaggggaaagacacrttcttaaacataacgtaattattttttattattagactagtggtgtctacttttaaatctaattctcacaatcctgctagtccattatttgccctttaac

SEQ ID NO: 111154 - DNA, 201 bp, Bos taurus
ggaaaggaagaggatcactctgataccaaaccaaagaaatggagctgatgcctctgtgaaagagagatatcaattagcccgaggggaggctgagttttatygtattcagtggagttactgagagtgctgggaggctgaacattgaaccaaatagagctcaaaggtcttgcatgcccatcaagaaaataaataaagcttaag

SEQ ID NO: 111155 - DNA, 201 bp, Bos taurus
aaactttcctggtggaagaaaagagaaattataaatgtatgagaagtgaagatcaatagttcttaaactatcatgtctagactggacagtgtaaagaaaayatgtcttgacatctctccctaaatgatgcagagtctcaaacacctttttaaagtgttaatctggacgcagagctgacgtgacggcgtcaggcgccgcggg

SEQ ID NO: 111156 - DNA, 201 bp, Bos taurus; identical to SEQ ID NO: 30100

SEQ ID NO: 111157 - DNA, 201 bp, Bos taurus
tttcttaaattatccttttttttctcctaggattttatatgtaataggaaagtatttactaaattgacctttctctaaaaatgcaaagtaattgaaaaggkcggtgagttttaacctgagaaatttcctttcgaatctctcaagtccaggtgttatatattctgaattattttttaaatggtaactaatatccttactgtt

SEQ ID NO: 111158 - DNA, 201 bp, Bos taurus; identical to SEQ ID NO: 30104

SEQ ID NO: 111159 - DNA, 201 bp, Bos taurus; identical to SEQ ID NO: 30105

SEQ ID NO: 111160 - DNA, 201 bp, Bos taurus; identical to SEQ ID NO: 30106

SEQ ID NO: 111161 - DNA, 201 bp, Bos taurus
agctcaacgtgtgaggttgggacaggagaggagcttgtagatctaggtggagatcagtgcatttgacatttcacatcctaatttaagggacttgatttttwtacagtggaatgagttggctggattttgccttcttgatatgtgccttttgtagccaggtatagaatgaacttgttgggaagtcaggcttgtaaataagaa

SEQ ID NO: 111162 - DNA, 201 bp, Bos taurus
ttcattttattctcttttacattaatcattaaaccaattttaatcttaaatgtctttaaaagtctgcccattatcaaccctgacacagtgttcaggatgcytgtcccaaatttacctaacctgtgtttctggcaaggtgtttctgtaataaacagaagagcacctagttcttaatatacttatttataccaggttaatcgg

SEQ ID NO: 111163 - DNA, 201 bp, Bos taurus
aattccacctatggatatatttatttattcttggatgtgcctgaagggctcacggttgtgtgaaagtgtggagttttcacacaccactcatgtcaccatcrtagttcacccccacacgtcctcagggaactgttgccccaactctgtcagatctacagttgtttcccttttctttaaattaaaacactccattacattgta

SEQ ID NO: 111164 - DNA, 201 bp, Bos taurus
ttgtggggttagcaatgtttgcatccctatgatgggaaatacacagggccatggtcagggatgggaggaaaagtaattatttttacacacaaaaggcaacrttggaaattgagaatataacacatcaacaaacctcaaatcatgctctaatatgagcagcaaagagctgaggtgaagaaggtgaccaaaatgaaattataa

SEQ ID NO: 111165 - DNA, 201 bp, Bos taurus
tacagagtgttttaccaagtcttatactcatattggaatgatgtgactctttcagtcactatatatttttatttcccttttgtgtaaccttatttctttcmtgatcctatttttgatactttaatatacttgattatttttttcaaagatatgcttataacagtacagagaaaaatggcagtctttgatggtgtcccctaa

SEQ ID NO: 111166 - DNA, 201 bp, Bos taurus
taattggaattttagattatttccaacatctgccaatgtaaatgttaccatacaaagagcatatttatttatataattgatctcccactccttatgaattwtatatatatgttttaagaatcagttctcaagaatgagatgactgggtttaaaatatgtagcttttttggagcttacaatttggcttatcgatttactttc

SEQ ID NO: 111167 - DNA, 201 bp, Bos taurus
gtacttgatcagtgctgctcaactaactggtgataaagcaggaataagaaccttggtcaaatgagatattgcccagtgttcttataccatatgaccaaccycttttttatatattgatgaaaaacttactgtagttttaacatattaattttttttcattttcctagacctaattttcataattagtgaataaaaattaaa

SEQ ID NO: 111168 - DNA, 201 bp, Bos taurus
attatggcatgacacatctgtagaacatttaggagactatttttttttttttaatgaggatttgtaataaactcacattcctcctcttcccacatggaagyactttagtgctatctctagcaagtcatgctttgccatgaatcatatactgtcttgatttcttcatttgtttagttaattagtacttcacctacctaactg

SEQ ID NO: 111169 - DNA, 201 bp, Bos taurus
gaataaaaattacaaaggcaaaatccttatttatgacaaagttattaagtaatgaataaggagataaagaaactgtatcaaaagatctcaaaaacatttcyccacagaagtctcaaataatacaagcagacaatccagaaaaaaagaaagaaaaacaaatgaccaatgaacgttttaaatcgtttgaactggctacaaata

SEQ ID NO: 111170 - DNA, 201 bp, Bos taurus; identical to SEQ ID NO: 30117

SEQ ID NO: 111171 - DNA, 201 bp, Bos taurus; identical to SEQ ID NO: 30120

SEQ ID NO: 111172 - DNA, 201 bp, Bos taurus
catgtgacaaaaaaatgaaagttttaaagtctggtatattttatatctttatgacatacagttatgaagaacgtggattagctctgaagtcaaaggtttargtttgtttccggtctccaaattcactacttcctaagagtgatggtgaacaagtcttaatctctttataactggaggttgtttttttttttattttttagt

SEQ ID NO: 111173 - DNA, 201 bp, Bos taurus; identical to SEQ ID NO: 30121

SEQ ID NO: 111174 - DNA, 201 bp, Bos taurus
cttgtggaactaaaagggaaaatatttgtgttgttttgagcctctatgttcatggcaattttttatagcagcaatagaaaactaattaaatataattattwtataactatctcctatgcttctcctgggtttcccagatatacctagtggtaaagaacctgcctaccagtgcaggagatgtaagagatgagagttggatcc

SEQ ID NO: 111175 - DNA, 201 bp, Bos taurus; identical to SEQ ID NO: 30122

SEQ ID NO: 111176 - DNA, 201 bp, Bos taurus; identical to SEQ ID NO: 30123

SEQ ID NO: 111177 - DNA, 201 bp, Bos taurus; identical to SEQ ID NO: 30124

SEQ ID NO: 111178 - DNA, 201 bp, Bos taurus; identical to SEQ ID NO: 30125

SEQ ID NO: 111179 - DNA, 201 bp, Bos taurus
tatatttcagatcaacaattttttctctttcacaggatttttttaatcacattttccatgtctttttcaataatttgacccttatgtttgtcttttgactrtgagattaacattgttctcgccttatcctttaattgtattagcgatcactgcttttaatgcatggtttatttagcctttatttggcttgcactgaagttg

SEQ ID NO: 111180 - DNA, 201 bp, Bos taurus
atttaaaacttctcttagaactagtccattacttggaaaatacttggtgaaaatactgcagtaaaactatagattttgttttctctttatgtgttttagayatacttaagaaggctaaccaaataggaaaacaggatgactccaatgtagaatttacacattgacaaaatggaaacctctctctatcatgtcccatattaa

SEQ ID NO: 111181 - DNA, 201 bp, Bos taurus
tgataagcaccattgaaatctagagagcaattctttctctttatctgtaaaacttcagtgactttagtataaaccacaaatgccttattttcaaaactcaktgatgtttgcctggcagtgaggttttgtgctttgaacagtctgttgtgttcagggttgatgtttagaaaatccttaataggagaagtttgcctcttttgt

SEQ ID NO: 111182 - DNA, 201 bp, Bos taurus; identical to SEQ ID NO: 30126

SEQ ID NO: 111183 - DNA, 201 bp, Bos taurus
caaggaattgctgttaagagtgacaatagccatgcctcagtgtgcatagaggttggctcggaaacaatgtataacacatgtgaggaatgaaagattgaaargctttcagctgtcccgacatgtggatgagccagttggctgttcccactcactgtccctttgtcatagtaagatcgccttcctctggagggtgtgtagaac

SEQ ID NO: 111184 - DNA, 201 bp, Bos taurus; identical to SEQ ID NO: 30134

SEQ ID NO: 111185 - DNA, 201 bp, Bos taurus
aaaccccttagagatacatgcaaatgctgttatgatctggtatctacaggtaggtagaaattaatattgagatttcattaaaactgaaaattggccagatwcaggaataccagatcttaccatgatctactatcactactcccttactatgatctaatatcactacaagttctctaaagagaattatgtacaaaagagggc

SEQ ID NO: 111186 - DNA, 201 bp, Bos taurus; identical to SEQ ID NO: 69906

SEQ ID NO: 111187 - DNA, 201 bp, Bos taurus; identical to SEQ ID NO: 30143

SEQ ID NO: 111188 - DNA, 201 bp, Bos taurus; identical to SEQ ID NO: 69909

SEQ ID NO: 111189 - DNA, 201 bp, Bos taurus; identical to SEQ ID NO: 30145

SEQ ID NO: 111190 - DNA, 201 bp, Bos taurus
cagaataatggttgtcttgagaaggaataataatggaaaggaatatgagggggacttgtatagtgctgaaatgttccatggattcatctggtgatggctamaagattatctttgctttgtgtgaatttgttatgatttgagcttgtttatcagttatgcaatatttcagttcagttcagtcactcagtagtatccaactct

SEQ ID NO: 111191 - DNA, 201 bp, Bos taurus
ttaaaatgcagatgccaaccccagagggtctaatccattttaagaaactctctgaggtcatcagtatgtccattttgtaaaacagtgtcctggcctcttcyattattgcatgatttcagaatggaaatactggtttcctccatgtgtgctgctgaagctcattatcatggtaatgacagtggccaatctaaaacttgccca

SEQ ID NO: 111192 - DNA, 201 bp, Bos taurus; identical to SEQ ID NO: 30146

SEQ ID NO: 111193 - DNA, 201 bp, Bos taurus
cctacagcaggctggtacctaccctgggccctctggactccacaaacagcaataccaagggtcccatccaccagcagtccagaagcctctggacaacacayggcctggcagacagctaggatgaagtcagctctgccaagcagcatgcccagaggagttggcctcacaacagaaaggcccatgaagcccccgtgggggtac

SEQ ID NO: 111194 - DNA, 201 bp, Bos taurus; identical to SEQ ID NO: 69915

SEQ ID NO: 111195 - DNA, 201 bp, Bos taurus; identical to SEQ ID NO: 30150

SEQ ID NO: 111196 - DNA, 201 bp, Bos taurus; identical to SEQ ID NO: 30151

SEQ ID NO: 111197 - DNA, 201 bp, Bos taurus
aaaatagaaagctcaataacaatttctaaccctttaattgcttagaaatacatttaatagagtctatatgagagaaattattaaatataaacaaatacgargtaagacagtattaagcgaaattgcattccactgtgaatcttaatgcttttattgtgttttgtttggggaactagattaaattattttaaagtttagatg

SEQ ID NO: 111198 - DNA, 201 bp, Bos taurus; identical to SEQ ID NO: 30152

SEQ ID NO: 111199 - DNA, 201 bp, Bos taurus; identical to SEQ ID NO: 30153

SEQ ID NO: 111200 - DNA, 201 bp, Bos taurus; identical to SEQ ID NO: 30154

SEQ ID NO: 111201 - DNA, 201 bp, Bos taurus
tgacctgtaagattcttttcagaataatcaccttgggcctcatgtgcattcagagaatctgtcataacagggggacaccgagctccctgtgcactgatgcycagggttctcatctcagggcctgacctagcacttccttccctgcttgacacctgaaggtctcagtagagttcccccacttggtaagggcactgcttttct

SEQ ID NO: 111202 - DNA, 201 bp, Bos taurus
atactagccaaattcctgaaagaaaaaaaaaggtcagcagaaaatggaagggcatatttaagttgctgaaagaaaaaaaaaaatctttatcaagtaaaccrtccttcaaaccagaagacaaactaaaaacatttgcaataaataaagtacagaattcatctctagtactttgtgttgtgagaagtgctagaaagaatcttt

SEQ ID NO: 111203 - DNA, 201 bp, Bos taurus
aagtagggccctgagatcccaggaacggtcccttctcacctagaacgtcaaacaaattactttattgcacatactgtgcctaaatgactaagtgcctctgyagcagtttcaggcctgtgccagctgtactgccagacagcagaaactaccaccccaccccagccccactccgggtcagagaaaggactggaaattgggggt

SEQ ID NO: 111204 - DNA, 201 bp, Bos taurus; identical to SEQ ID NO: 30158

SEQ ID NO: 111205 - DNA, 201 bp, Bos taurus
agcagtatctggccaatctgtcctgtttttgccattagcagtttgtttcccttaactgagcttctgtgactttccttacacacagctcaagtagtttccakgacactgtggataaggcccagagcttatcatcatggtgccctgagatgaagttaatcaggtttaagttgtccatgacagcaacacaaactggactgaatt

SEQ ID NO: 111206 - DNA, 201 bp, Bos taurus
aacagcaaatcatataaaataatggcttagtaattaaaataaaaactagaatacttttcttgatagctggtacctgaataagtgttcaaagacaggaatakagttcaactcaggcccagattcatagaatctgcctaaacagaaattgtggtaaattctataagctaacatctatatgttcaaaaaagttacatggaaacc

SEQ ID NO: 111207 - DNA, 201 bp, Bos taurus; identical to SEQ ID NO: 30163

SEQ ID NO: 111208 - DNA, 201 bp, Bos taurus; identical to SEQ ID NO: 69929

SEQ ID NO: 111209 - DNA, 201 bp, Bos taurus
cccatgtggcatagaactgaagtctcctgtcatagttctgtgagtgagctgtcctagaatcggatcctccagccccaatcaagtgttctgatgactgcagycctggccagtatcgtaactgtgtcccatgagagactctgattcagaacctctcatctaagcctcttcctgaacttgagacccataataactgtgagataa

SEQ ID NO: 111210 - DNA, 201 bp, Bos taurus; identical to SEQ ID NO: 30164

SEQ ID NO: 111211 - DNA, 201 bp, Bos taurus; identical to SEQ ID NO: 30165

SEQ ID NO: 111212 - DNA, 201 bp, Bos taurus; identical to SEQ ID NO: 30166

SEQ ID NO: 111213 - DNA, 201 bp, Bos taurus
agttttatgatcacaggatataaagaaaggactcaattttaattcgtgcattttttgtttgttttagaagaacatgacagaatgatcaataaaaaactttmaagcataaacaaccatacattaggataagattttgtggaataagcagaatagatggaaaataaagatgtaaaatattcaaatgctaaagggaagtttgtt

SEQ ID NO: 111214 - DNA, 201 bp, Bos taurus; identical to SEQ ID NO: 30167

SEQ ID NO: 111215 - DNA, 201 bp, Bos taurus; identical to SEQ ID NO: 30171

SEQ ID NO: 111216 - DNA, 201 bp, Bos taurus
tgtgaggcaaggtggcctgaggaaaaaagaactctcctgtctttctgagttttttgtggaatgcccttagtttgtttcttagaattaggtttggctacaartaaatgtaaatccaaattaacaatgacttaaatacacaaaatttcactcttggatacagacagtccaaggctgtttaccactcttagcaggtatctcatc

SEQ ID NO: 111217 - DNA, 201 bp, Bos taurus; identical to SEQ ID NO: 30172

SEQ ID NO: 111218 - DNA, 201 bp, Bos taurus
ccacaaaggttgaactcaggaatcggaattgacccaatcaatacttgacattccccaggcctcagtggtgtgttcataaataagcatgtggccagatttgrtcagatcagaatgaagcctgtgacgttcactccatggttgttgagtttctctatgtcttgctttcctttccctcccttctcccctctctgaagaagcacg

SEQ ID NO: 111219 - DNA, 201 bp, Bos taurus; identical to SEQ ID NO: 30174

SEQ ID NO: 111220 - DNA, 201 bp, Bos taurus; identical to SEQ ID NO: 30175

SEQ ID NO: 111221 - DNA, 201 bp, Bos taurus; identical to SEQ ID NO: 30176

SEQ ID NO: 111222 - DNA, 201 bp, Bos taurus
tagtgggagcatgaacttgaccttccttgttcctggggcacatgcctaaccaagtgctcatggaccactaagctgtggggtcagggtgttctttctgaggyagggaaatgtggtccaggtctaaaaagcccacagacagcctcttaagggctaccgtactagcacatcctgaaggagtttaaacatccattgtagcccccg

SEQ ID NO: 111223 - DNA, 201 bp, Bos taurus; identical to SEQ ID NO: 30177

SEQ ID NO: 111224 - DNA, 201 bp, Bos taurus
tgctcagaaaacaggctgaaaggttaaaaacagaccactgcggcctaaatgtgtcacctggctccttcaggagctctgctaatcagtctatctaggcagtratcacagaaagactggccggtggcagagagctatcacgagggaaggtcagaaaaccaagaggctgcctggcaacatggagctgccttttttatggaattt

SEQ ID NO: 111225 - DNA, 201 bp, Bos taurus; identical to SEQ ID NO: 69942

SEQ ID NO: 111226 - DNA, 201 bp, Bos taurus; identical to SEQ ID NO: 69943

SEQ ID NO: 111227 - DNA, 201 bp, Bos taurus; identical to SEQ ID NO: 30179

SEQ ID NO: 111228 - DNA, 201 bp, Bos taurus; identical to SEQ ID NO: 30180

SEQ ID NO: 111229 - DNA, 201 bp, Bos taurus; identical to SEQ ID NO: 30181

SEQ ID NO: 111230 - DNA, 201 bp, Bos taurus; identical to SEQ ID NO: 30182

SEQ ID NO: 111231 - DNA, 201 bp, Bos taurus; identical to SEQ ID NO: 30183

SEQ ID NO: 111232 - DNA, 201 bp, Bos taurus; identical to SEQ ID NO: 30184

SEQ ID NO: 111233 - DNA, 201 bp, Bos taurus
acctggctagaagatggacccctcctatctttccctttctgaatgcctttctgttcttctggtctgatcccatttgcgtcttgtctgttagtgagagcccrgcaatggtcatgctctgacaccaaccccttctctccccactgtgtagctccatattctggccttgctttccactgaagcttggtcagctctgcatgcgtc

SEQ ID NO: 111234 - DNA, 201 bp, Bos taurus; identical to SEQ ID NO: 30187

SEQ ID NO: 111235 - DNA, 201 bp, Bos taurus; identical to SEQ ID NO: 30188

SEQ ID NO: 111236 - DNA, 201 bp, Bos taurus; identical to SEQ ID NO: 30189

SEQ ID NO: 111237 - DNA, 201 bp, Bos taurus; identical to SEQ ID NO: 69950

SEQ ID NO: 111238 - DNA, 201 bp, Bos taurus; identical to SEQ ID NO: 30195

SEQ ID NO: 111239 - DNA, 201 bp, Bos taurus
caatattagtagctgaaataagattcttggccactgtgatatcgtgattaaaaaaaaatatctgttgggcttcattcccagttcctggcacagagctcttrgaatttcctgagtgtatgggtgagcagagtgtcttttttcccccctaataagctcctttcaactatatcagagtttatgctaatgagctagctttctgag

SEQ ID NO: 111240 - DNA, 201 bp, Bos taurus; identical to SEQ ID NO: 30196

SEQ ID NO: 111241 - DNA, 201 bp, Bos taurus; identical to SEQ ID NO: 30197

SEQ ID NO: 111242 - DNA, 201 bp, Bos taurus; identical to SEQ ID NO: 30198

SEQ ID NO: 111243 - DNA, 201 bp, Bos taurus; identical to SEQ ID NO: 30199

SEQ ID NO: 111244 - DNA, 201 bp, Bos taurus; identical to SEQ ID NO: 30200

SEQ ID NO: 111245 - DNA, 201 bp, Bos taurus
cttctccaatgcatgaaagtgaaaagtgaaagtgaagtcgctcagtcgtgtccgactcttctggctctggttaaacaacctgcccagggcttgactcagartagatgcttaacacttatttgtcaggggaaaattagaattccatgtttattaaatttcagcagttctggttcaaccaaggaccaaaacctaagcaccata

SEQ ID NO: 111246 - DNA, 201 bp, Bos taurus; identical to SEQ ID NO: 69961

SEQ ID NO: 111247 - DNA, 201 bp, Bos taurus; identical to SEQ ID NO: 30202

SEQ ID NO: 111248 - DNA, 201 bp, Bos taurus; identical to SEQ ID NO: 30204

SEQ ID NO: 111249 - DNA, 201 bp, Bos taurus
tacactgaacacatatttatacatgcacacaaacagggagtcagtctaccaacttgtttgtggtgggaatacaaagttgtagtgatttttttctctcaaakatcttgcagtttagatggaagtaacttaaaatacaaataagattgccttccatgggcaaggcactcaatgaatatttgtagaataaataaatacataaaa

SEQ ID NO: 111250 - DNA, 201 bp, Bos taurus; identical to SEQ ID NO: 30205

SEQ ID NO: 111251 - DNA, 201 bp, Bos taurus
agtctttaggtgattattaagattaaattagatcataagagtgggccctagttcaatgagatcatgaccttttaagaaggagaaagcaatttgtcttcacytacatgtactgcagaaaggccatgagaagaaaacactgtgagaaggtagccttatgcaagccaagacaagaggcttcagaatgaaatctaccttgttggc

SEQ ID NO: 111252 - DNA, 201 bp, Bos taurus; identical to SEQ ID NO: 30206

SEQ ID NO: 111253 - DNA, 201 bp, Bos taurus; identical to SEQ ID NO: 30207

SEQ ID NO: 111254 - DNA, 201 bp, Bos taurus; identical to SEQ ID NO: 30208

SEQ ID NO: 111255 - DNA, 201 bp, Bos taurus; identical to SEQ ID NO: 30209

SEQ ID NO: 111256 - DNA, 201 bp, Bos taurus; identical to SEQ ID NO: 30210

SEQ ID NO: 111257 - DNA, 201 bp, Bos taurus; identical to SEQ ID NO: 30211

SEQ ID NO: 111258 - DNA, 201 bp, Bos taurus; identical to SEQ ID NO: 30212

SEQ ID NO: 111259 - DNA, 201 bp, Bos taurus; identical to SEQ ID NO: 30214

SEQ ID NO: 111260 - DNA, 201 bp, Bos taurus; identical to SEQ ID NO: 30215

SEQ ID NO: 111261 - DNA, 201 bp, Bos taurus; identical to SEQ ID NO: 30216

SEQ ID NO: 111262 - DNA, 201 bp, Bos taurus; identical to SEQ ID NO: 30217

SEQ ID NO: 111263 - DNA, 201 bp, Bos taurus; identical to SEQ ID NO: 30218

SEQ ID NO: 111264 - DNA, 201 bp, Bos taurus; identical to SEQ ID NO: 30219

SEQ ID NO: 111265 - DNA, 201 bp, Bos taurus; identical to SEQ ID NO: 30220

SEQ ID NO: 111266 - DNA, 201 bp, Bos taurus; identical to SEQ ID NO: 30221

SEQ ID NO: 111267 - DNA, 201 bp, Bos taurus; identical to SEQ ID NO: 30222

SEQ ID NO: 111268 - DNA, 201 bp, Bos taurus; identical to SEQ ID NO: 30223

SEQ ID NO: 111269 - DNA, 201 bp, Bos taurus; identical to SEQ ID NO: 30224

SEQ ID NO: 111270 - DNA, 201 bp, Bos taurus; identical to SEQ ID NO: 30225

SEQ ID NO: 111271 - DNA, 201 bp, Bos taurus; identical to SEQ ID NO: 30226

SEQ ID NO: 111272 - DNA, 201 bp, Bos taurus; identical to SEQ ID NO: 30227

SEQ ID NO: 111273 - DNA, 201 bp, Bos taurus; identical to SEQ ID NO: 30228

SEQ ID NO: 111274 - DNA, 201 bp, Bos taurus; identical to SEQ ID NO: 30229

SEQ ID NO: 111275 - DNA, 201 bp, Bos taurus; identical to SEQ ID NO: 30231

SEQ ID NO: 111276 - DNA, 201 bp, Bos taurus; identical to SEQ ID NO: 30232

SEQ ID NO: 111277 - DNA, 201 bp, Bos taurus; identical to SEQ ID NO: 30233

SEQ ID NO: 111278 - DNA, 201 bp, Bos taurus; identical to SEQ ID NO: 30234

SEQ ID NO: 111279 - DNA, 201 bp, Bos taurus; identical to SEQ ID NO: 30235

SEQ ID NO: 111280 - DNA, 201 bp, Bos taurus; identical to SEQ ID NO: 30236

SEQ ID NO: 111281 - DNA, 201 bp, Bos taurus; identical to SEQ ID NO: 30237

SEQ ID NO: 111282 - DNA, 201 bp, Bos taurus; identical to SEQ ID NO: 30238

SEQ ID NO: 111283 - DNA, 201 bp, Bos taurus; identical to SEQ ID NO: 30239

SEQ ID NO: 111284 - DNA, 201 bp, Bos taurus; identical to SEQ ID NO: 30240

SEQ ID NO: 111285 - DNA, 201 bp, Bos taurus; identical to SEQ ID NO: 30241

SEQ ID NO: 111286 - DNA, 201 bp, Bos taurus; identical to SEQ ID NO: 30242

SEQ ID NO: 111287 - DNA, 201 bp, Bos taurus; identical to SEQ ID NO: 30243

SEQ ID NO: 111288 - DNA, 201 bp, Bos taurus; identical to SEQ ID NO: 30244

SEQ ID NO: 111289 - DNA, 201 bp, Bos taurus; identical to SEQ ID NO: 70002

SEQ ID NO: 111290 - DNA, 201 bp, Bos taurus; identical to SEQ ID NO: 70003

SEQ ID NO: 111291 - DNA, 201 bp, Bos taurus; identical to SEQ ID NO: 30248

SEQ ID NO: 111292 - DNA, 201 bp, Bos taurus; identical to SEQ ID NO: 70004

SEQ ID NO: 111293 - DNA, 201 bp, Bos taurus; identical to SEQ ID NO: 70005

SEQ ID NO: 111294 - DNA, 201 bp, Bos taurus; identical to SEQ ID NO: 70006

SEQ ID NO: 111295 - DNA, 201 bp, Bos taurus; identical to SEQ ID NO: 70007

SEQ ID NO: 111296 - DNA, 201 bp, Bos taurus; identical to SEQ ID NO: 70008

SEQ ID NO: 111297 - DNA, 201 bp, Bos taurus; identical to SEQ ID NO: 70010

SEQ ID NO: 111298 - DNA, 201 bp, Bos taurus; identical to SEQ ID NO: 70011

SEQ ID NO: 111299 - DNA, 201 bp, Bos taurus; identical to SEQ ID NO: 70014

SEQ ID NO: 111300 - DNA, 201 bp, Bos taurus; identical to SEQ ID NO: 70015

SEQ ID NO: 111301 - DNA, 201 bp, Bos taurus; identical to SEQ ID NO: 30253

SEQ ID NO: 111302 - DNA, 201 bp, Bos taurus; identical to SEQ ID NO: 30255

SEQ ID NO: 111303 - DNA, 201 bp, Bos taurus; identical to SEQ ID NO: 30259

SEQ ID NO: 111304 - DNA, 201 bp, Bos taurus; identical to SEQ ID NO: 30260

SEQ ID NO: 111305 - DNA, 201 bp, Bos taurus; identical to SEQ ID NO: 30261

SEQ ID NO: 111306 - DNA, 201 bp, Bos taurus; identical to SEQ ID NO: 30262

SEQ ID NO: 111307 - DNA, 201 bp, Bos taurus; identical to SEQ ID NO: 30263

SEQ ID NO: 111308 - DNA, 201 bp, Bos taurus; identical to SEQ ID NO: 30264

SEQ ID NO: 111309 - DNA, 201 bp, Bos taurus; identical to SEQ ID NO: 70028

SEQ ID NO: 111310 - DNA, 201 bp, Bos taurus; identical to SEQ ID NO: 70029

SEQ ID NO: 111311 - DNA, 201 bp, Bos taurus; identical to SEQ ID NO: 30333

SEQ ID NO: 111312 - DNA, 201 bp, Bos taurus; identical to SEQ ID NO: 30334

SEQ ID NO: 111313 - DNA, 201 bp, Bos taurus; identical to SEQ ID NO: 30335

SEQ ID NO: 111314 - DNA, 201 bp, Bos taurus; identical to SEQ ID NO: 30336

SEQ ID NO: 111315 - DNA, 201 bp, Bos taurus; identical to SEQ ID NO: 30337

SEQ ID NO: 111316 - DNA, 201 bp, Bos taurus; identical to SEQ ID NO: 30338

SEQ ID NO: 111317 - DNA, 201 bp, Bos taurus; identical to SEQ ID NO: 30339

SEQ ID NO: 111318 - DNA, 201 bp, Bos taurus; identical to SEQ ID NO: 30340

SEQ ID NO: 111319 - DNA, 201 bp, Bos taurus; identical to SEQ ID NO: 30341

SEQ ID NO: 111320 - DNA, 201 bp, Bos taurus; identical to SEQ ID NO: 30342

SEQ ID NO: 111321 - DNA, 201 bp, Bos taurus; identical to SEQ ID NO: 30343

SEQ ID NO: 111322 - DNA, 201 bp, Bos taurus; identical to SEQ ID NO: 30344

SEQ ID NO: 111323 - DNA, 201 bp, Bos taurus; identical to SEQ ID NO: 30345

SEQ ID NO: 111324 - DNA, 201 bp, Bos taurus; identical to SEQ ID NO: 30346

SEQ ID NO: 111325 - DNA, 201 bp, Bos taurus; identical to SEQ ID NO: 30348

SEQ ID NO: 111326 - DNA, 201 bp, Bos taurus; identical to SEQ ID NO: 30349

SEQ ID NO: 111327 - DNA, 201 bp, Bos taurus; identical to SEQ ID NO: 30350

SEQ ID NO: 111328 - DNA, 201 bp, Bos taurus; identical to SEQ ID NO: 30351

SEQ ID NO: 111329 - DNA, 201 bp, Bos taurus; identical to SEQ ID NO: 30352

SEQ ID NO: 111330 - DNA, 201 bp, Bos taurus; identical to SEQ ID NO: 30353

SEQ ID NO: 111331 - DNA, 201 bp, Bos taurus; identical to SEQ ID NO: 30354

SEQ ID NO: 111332 - DNA, 201 bp, Bos taurus; identical to SEQ ID NO: 30355

SEQ ID NO: 111333 - DNA, 201 bp, Bos taurus; identical to SEQ ID NO: 30356

SEQ ID NO: 111334 - DNA, 201 bp, Bos taurus; identical to SEQ ID NO: 30357

SEQ ID NO: 111335 - DNA, 201 bp, Bos taurus; identical to SEQ ID NO: 30358

SEQ ID NO: 111336 - DNA, 201 bp, Bos taurus; identical to SEQ ID NO: 30359

SEQ ID NO: 111337 - DNA, 201 bp, Bos taurus; identical to SEQ ID NO: 30360

SEQ ID NO: 111338 - DNA, 201 bp, Bos taurus; identical to SEQ ID NO: 30361

SEQ ID NO: 111339 - DNA, 201 bp, Bos taurus; identical to SEQ ID NO: 30362

SEQ ID NO: 111340 - DNA, 201 bp, Bos taurus; identical to SEQ ID NO: 30366

SEQ ID NO: 111341 - DNA, 201 bp, Bos taurus; identical to SEQ ID NO: 30367

SEQ ID NO: 111342 - DNA, 201 bp, Bos taurus; identical to SEQ ID NO: 30368

SEQ ID NO: 111343 - DNA, 201 bp, Bos taurus; identical to SEQ ID NO: 30369

SEQ ID NO: 111344 - DNA, 201 bp, Bos taurus; identical to SEQ ID NO: 30370

SEQ ID NO: 111345 - DNA, 201 bp, Bos taurus; identical to SEQ ID NO: 30371

SEQ ID NO: 111346 - DNA, 201 bp, Bos taurus; identical to SEQ ID NO: 30372

SEQ ID NO: 111347 - DNA, 201 bp, Bos taurus; identical to SEQ ID NO: 30373

SEQ ID NO: 111348 - DNA, 201 bp, Bos taurus; identical to SEQ ID NO: 30374

SEQ ID NO: 111349 - DNA, 201 bp, Bos taurus; identical to SEQ ID NO: 30375

SEQ ID NO: 111350 - DNA, 201 bp, Bos taurus; identical to SEQ ID NO: 30376

SEQ ID NO: 111351 - DNA, 201 bp, Bos taurus; identical to SEQ ID NO: 30377

SEQ ID NO: 111352 - DNA, 201 bp, Bos taurus; identical to SEQ ID NO: 30378

SEQ ID NO: 111353 - DNA, 201 bp, Bos taurus; identical to SEQ ID NO: 30379

SEQ ID NO: 111354 - DNA, 201 bp, Bos taurus; identical to SEQ ID NO: 30380

SEQ ID NO: 111355 - DNA, 201 bp, Bos taurus; identical to SEQ ID NO: 30381

SEQ ID NO: 111356 - DNA, 201 bp, Bos taurus; identical to SEQ ID NO: 30382

SEQ ID NO: 111357 - DNA, 201 bp, Bos taurus; identical to SEQ ID NO: 30383

SEQ ID NO: 111358 - DNA, 201 bp, Bos taurus; identical to SEQ ID NO: 30384

SEQ ID NO: 111359 - DNA, 201 bp, Bos taurus; identical to SEQ ID NO: 30385

SEQ ID NO: 111360 - DNA, 201 bp, Bos taurus; identical to SEQ ID NO: 30386

SEQ ID NO: 111361 - DNA, 201 bp, Bos taurus; identical to SEQ ID NO: 30387

SEQ ID NO: 111362 - DNA, 201 bp, Bos taurus; identical to SEQ ID NO: 30388

SEQ ID NO: 111363 - DNA, 201 bp, Bos taurus; identical to SEQ ID NO: 30389

SEQ ID NO: 111364 - DNA, 201 bp, Bos taurus
cccttggtcatgcctgtcaggctgcgaggagggagagagctgagaaagatctaagcctgagcctgtgaagttgcaggggagggaacttggttgtttgaaasgaatgagcttggccatggggattcggtgctggcagggcagccacagcccattgtaaagagtctggatatcacttgctggggccaatccatatcataggag

SEQ ID NO: 111365 - DNA, 201 bp, Bos taurus
tttgataaattcaacattaatagaatataacttccttgattaagttatgatatatggcttcaaaagagatcactcaagtgggccaagttaataataaaatkttaaaatctacatgaaggagtcagaaagaagaatactgaggtccagaatcactgttccattgctggcttaaaaatggaaagagccacgtggcaaataatt

SEQ ID NO: 111366 - DNA, 201 bp, Bos taurus
ctttgtcaagcttatttcctgatacaacaatgaatttggctacagcaacagagtgatggacctcatggtctacatggcctccaaggagtaagagtccctgraccaccagccctagcaagagcatgaaaggaagagagaggtcctcaactcttggggagtccttgccccaccttgatcctccagcacactgagaaatctccc

SEQ ID NO: 111367 - DNA, 201 bp, Bos taurus; identical to SEQ ID NO: 30390

SEQ ID NO: 111368 - DNA, 201 bp, Bos taurus
catgcaaagccccaggcatgtaaagtacatgaaagatatttaaccatactggttaagaccactgtctctgtccactctggcatcaaattgtgccaagtgartctggggtgggcctgagccatttttttccctaaatatgcattcatgttcatacgtaatacctaatttttgttcattctttcagcaaatatttattgagca

SEQ ID NO: 111369 - DNA, 201 bp, Bos taurus; identical to SEQ ID NO: 30391

SEQ ID NO: 111370 - DNA, 201 bp, Bos taurus; identical to SEQ ID NO: 30392

SEQ ID NO: 111371 - DNA, 201 bp, Bos taurus; identical to SEQ ID NO: 30395

SEQ ID NO: 111372 - DNA, 201 bp, Bos taurus
atcttacttgggaaatggagtttgcagttaagagaccttgacacaataagattatattgatttattcagttggacctccaatgtaatcacagttcagttcmgttgctcagtcatgtctgacttttggtgaccccatggactaaagcatgccaggcttccctgtccatcaccaactcccggagtttactcaaactcttgtcc

SEQ ID NO: 111373 - DNA, 201 bp, Bos taurus
caattgctccggtggcattaacatctgatttccacttaattgatctgatcaactctgccctgatctgaactggtcaccaagacaagtgaaagccccggatygaccctgccaccgtctgctgtttttcagttgtctagacatagtcataaatagctggatgactgcccactataaatttttaatgagagattttgaaattag

SEQ ID NO: 111374 - DNA, 201 bp, Bos taurus; identical to SEQ ID NO: 30397

SEQ ID NO: 111375 - DNA, 201 bp, Bos taurus; identical to SEQ ID NO: 30398

SEQ ID NO: 111376 - DNA, 201 bp, Bos taurus; identical to SEQ ID NO: 30399

SEQ ID NO: 111377 - DNA, 201 bp, Bos taurus
ggccccaccctcaggggctctgggagcttctttggctgaaagtgttttggcagactcagctttctctgtcatcagtttgaattcatgggaaagggcaagaygccaaaagtgcttgcaggtgaattctttgtccctttcaagtgcatctgacttacacagatgacttatgtgggtgtttatcttatgttgggaggattatca

SEQ ID NO: 111378 - DNA, 201 bp, Bos taurus
ccagtggtaagatgatataaatgtgaacttcttaaaaacacactcagaccatgttctcatgtctacccagagacacaaagcttcctgaccaaccaccaatyccagcgatgcccagttcatccatctttgactagtagaccctgctgatagaactaacactctttgggaataggaaagagattgatgcgaagaaagaagtgt

SEQ ID NO: 111379 - DNA, 201 bp, Bos taurus
ccccctaatctccctccccatttcctcccctactcaacctccccaggagctagttatgagtgtattcaggcagatttctgcatggaagctctagccaaagmaatgtgataaattcctagaatatataccagtccttcatgtcaaagcagcttctggcatgaggattacactaggatttactgaacttggttcatctatctt

SEQ ID NO: 111380 - DNA, 201 bp, Bos taurus
aagcattatgtttcctctctgtaaagtgtagctcatttaactctattctaaacctgtcgtgagactgaaatgattcaattttccttttgggattataggcrgacatttacataagcaatatgtatttattgtagaaatattggaaaatactaaataaagagtgcacagaataaaaatcataccactctgggttactgctct

SEQ ID NO: 111381 - DNA, 201 bp, Bos taurus
aaatgaagacaaaaatagaaagaatggatgggggaatccaggaaaagaagcttctaaggaataagaccctttcacgatggtatttattaatattgcttgcygtctgtggtcttatttggatgaacatggtcagtttggtgagagtactcacacaggcgctaatgagggaggaccagatcttccttaatatttgaccagacc

SEQ ID NO: 111382 - DNA, 201 bp, Bos taurus; identical to SEQ ID NO: 30402

SEQ ID NO: 111383 - DNA, 201 bp, Bos taurus; identical to SEQ ID NO: 70181

SEQ ID NO: 111384 - DNA, 201 bp, Bos taurus; identical to SEQ ID NO: 70182

SEQ ID NO: 111385 - DNA, 201 bp, Bos taurus
cagtcccagcatccctcgggcgctatgctcaaaaagcacagatttgttggtgcctgctaagtcacttcagttgtgcctgactctttgtgaccctcaaactragaatgaggctgtgatgggaagccccgccctgccctttgcgtgcatgttaacagtgaggcccctctggcagacccaggctaggtcctgagtgcacctcag

SEQ ID NO: 111386 - DNA, 201 bp, Bos taurus
aaacaaaatgaaaacagagaaaagaatttataaggtaaaactttttgacttgaataacaatctcccaaattgtcctccttcgttcacacagcaaaggtcckccatcttagctgtaccaccaatagcaggtgctggggtgtgtgtgtgtgtgggggggactcctgcctgctgactctcagaagcggccttgactccaggaac

SEQ ID NO: 111387 - DNA, 201 bp, Bos taurus
aagcattttcttaactatgcattttgattgtttcattgtttatctttgtacttcaactggagtttaaatatttaattgtttccggagaactggaagaaaakcttatttcagaactcttcacacgaactgccaaattgctttttggaaaatgtatcttagttattgttctgaactgcaatccaagactgctagtctattgtc

SEQ ID NO: 111388 - DNA, 201 bp, Bos taurus
aagacccggctctagcggacggtggctcggcccgggtcgagaggggcgcaccagttggcggctcacggtcgtaccagaagtatgagagccaaggtagccaycaggccctggaacggcgcgccccgagagccccgagctggcacggccggagaaccagggtaggcagagaagagacgcttgcaaggtcggccaggggtccgc

SEQ ID NO: 111389 - DNA, 201 bp, Bos taurus; identical to SEQ ID NO: 70233

SEQ ID NO: 111390 - DNA, 201 bp, Bos taurus
aagggagtgccttccatagcaaagtcctggccactctcagccttgggggtggttcctggagcaaccttgaccaccagatcagatggagccacggagagggrggggcggggggcctggtgggagaattatccttaaccctcttacacaagcttcccttttccaaatttgctgttaaagaattccatgctgtattggtcctag

SEQ ID NO: 111391 - DNA, 201 bp, Bos taurus; identical to SEQ ID NO: 70237

SEQ ID NO: 111392 - DNA, 201 bp, Bos taurus; identical to SEQ ID NO: 70238

SEQ ID NO: 111393 - DNA, 201 bp, Bos taurus
agtggagccttccctgcctgcccccgttccccacccagaagagggatgagatgcggttgtgcatacatgcacgctcagtcattcagttgtgtgtgactctytgctaccttgtggactgtagctcaccaggctcctctgttcatgggatttttcaggcaagaacactagagtgagttgccatttcctactccatgggatctt

SEQ ID NO: 111394 - DNA, 201 bp, Bos taurus
ggtcttcgtggcccagccagttctaggccaggacataggtcttactagactttctctgttctctcccagggatcaacaaacgagaggccaagaactgcaaygccatccgccactttgagaacaccttcgtggtggagacgctcatctgcggggtggtgtgaagccccacccctgccctccaggccccgccccatcttccag

SEQ ID NO: 111395 - DNA, 201 bp, Bos taurus
ttcgggggctctgcagaggaaaaaggcccaggggtgtgctttggaaacagagttccagttttgtatccagctcttcctgcacccctggcacagaaggatcyccaagccccctggcccaaaggaggtaatgttgctctttcttccctaatgctgcgatccctggccatctggacccttagccccacagcgccatctgggggt

SEQ ID NO: 111396 - DNA, 201 bp, Bos taurus; identical to SEQ ID NO: 70241

SEQ ID NO: 111397 - DNA, 201 bp, Bos taurus; identical to SEQ ID NO: 70242

SEQ ID NO: 111398 - DNA, 201 bp, Bos taurus; identical to SEQ ID NO: 70243

SEQ ID NO: 111399 - DNA, 201 bp, Bos taurus; identical to SEQ ID NO: 30463

SEQ ID NO: 111400 - DNA, 201 bp, Bos taurus
ggacgttgatgtggccccgtgaacgactcaggatggaggggtactgacagccgtgctgttccctccctggaacctgggctatgttcttccctccacttagygattgggaaaaccgaggccttgccagcagccaggtggatggggaggtgtctagcccacgctttcaaagtaacactcttgaagcacctaagtggcaagaga

SEQ ID NO: 111401 - DNA, 201 bp, Bos taurus
aatctgataggcagaacagtgcattacagcctacactacaaaactagtataaggctttctgtgacaaatctatgtcactggctgcaattcaaagtattaayacctatcttcaaaaattatgaacacgataaatttattcagtttaaaaagtttaaaaataatacttatgattccatttaataagaggaaatacaataaaca

SEQ ID NO: 111402 - DNA, 201 bp, Bos taurus; identical to SEQ ID NO: 30465

SEQ ID NO: 111403 - DNA, 201 bp, Bos taurus; identical to SEQ ID NO: 30466

SEQ ID NO: 111404 - DNA, 201 bp, Bos taurus
agttcgtcaacagcttcgtttcctgtctgacatctgctgggagatttcccagttggttctctgtcaagccgtgtggccatgggccactcagtccctttttmttggacctcagtccctgttctagaaatccagatggctggactagatggtccctggggccccttcctattccggccgtctgaggaggaaaggaggggcctg

SEQ ID NO: 111405 - DNA, 201 bp, Bos taurus; identical to SEQ ID NO: 30470

SEQ ID NO: 111406 - DNA, 201 bp, Bos taurus; identical to SEQ ID NO: 30473

SEQ ID NO: 111407 - DNA, 201 bp, Bos taurus; identical to SEQ ID NO: 30476

SEQ ID NO: 111408 - DNA, 201 bp, Bos taurus; identical to SEQ ID NO: 30480

SEQ ID NO: 111409 - DNA, 201 bp, Bos taurus
atatcatctgccatccatggtgggtagacccagtgtgacgcctctgctccagttccagccccagaaattccagaaaaggctgaatgttttcctggtgcccygggcctggtgaggaagcccacagccccccacacttcacagttgcacccccacatactctgtgtctgtgggtctctccctccctgggaatggctctgagat

SEQ ID NO: 111410 - DNA, 201 bp, Bos taurus
aatggagttgttgttattgctccaaattaggcaccaatttgcccgtgtaattgttggctaattggcatgaaatcctaatgtaattagttgggccccttatyggggagcttggggagccaggggcggtgggggtgggccgctggagcagggagggtctagaagtctggggaaatgtgtctgagggaggaggccctgagctgc

SEQ ID NO: 111411 - DNA, 201 bp, Bos taurus
actagatggtagccccagtggtgggagatggggaccgaggctctgactgctgcccccaaacactgggacctcatcctgttggtggagggccttaaggaagygagaagttaggcagcgtgggggaagagggatgagtcagacgtagtccctgctctcggggagctcctggccacgtgggggatgtggcggagacccagctag

SEQ ID NO: 111412 - DNA, 201 bp, Bos taurus
gtagccagggctggggttgtcagcgtgaagctcgccatggccctgtgagggagaggggcatcagcagagtggagcatcagcccgcccgccgggaccataargctgccaccagaggtgaaagatgggtccccctgccactgggatgcagagagccgtggagacgtggtgacagggctgatttagcgggggaggagggaggat

SEQ ID NO: 111413 - DNA, 201 bp, Bos taurus
tttgctaatggcttctggttttgcgtcatataaaggtctttcaaactccaaagttaatcagaaacccttctatgttttcttctgccgtttttatggtttcrtaatgtatccactggttcatggaactggaagcttttcttgtcattttctcagcggtgagcacctagctggatcctgaaaggcttggggtctgggtagaga

SEQ ID NO: 111414 - DNA, 201 bp, Bos taurus; identical to SEQ ID NO: 70260

SEQ ID NO: 111415 - DNA, 201 bp, Bos taurus
gcagagccagcccagaggaagatcgtcatgcacaaggtaggccagtctgtgcaagtctcaatcagagaggaggagccggccctcgcgtcttctcagttctrcaatacaggagggtgggcatcttgcttcttcttgcacagtttctcactagattgtgacttctttttccttttatctggagtggccgctgtccttgtgttt

SEQ ID NO: 111416 - DNA, 201 bp, Bos taurus; identical to SEQ ID NO: 30482

SEQ ID NO: 111417 - DNA, 201 bp, Bos taurus; identical to SEQ ID NO: 30483

SEQ ID NO: 111418 - DNA, 201 bp, Bos taurus
gattcctggccaagtgccccccaacctcatgaaaattacttcactccagtggaggtgggggagggtggggctgttattttacaggggaaggactgcagccycaggaaggagtggagtaaaatggggccaagtcacacagccaggaaggtcccacccaggatccacccacccacgtgggggcagggaggagtcagggccggg

SEQ ID NO: 111419 - DNA, 201 bp, Bos taurus
gcccattttcaggctgccctgtccatggttggtgaagcccccaggacactggagaacccctagctggagaggcagagggaagcagggcctgagtggggagygatcattgcacttggaaccacccagcacaagtgcatgtgagcccagagctggtccaggggacacggggcggggtatccaaagcttctgccacggacatca

SEQ ID NO: 111420 - DNA, 201 bp, Bos taurus
taggctcctctgtccatggaattctccaggcaagaatactggagtgggttgccatgcccttctccagctggggcccatcaattaccttgcagcttcagaayaaggaagggaggaggaaactgcctttgctgtgggtttggaagtggggagccctgggtttgaattctggatgattcatccctttctggctgtgggaccttg

SEQ ID NO: 111421 - DNA, 201 bp, Bos taurus; identical to SEQ ID NO: 70267

SEQ ID NO: 111422 - DNA, 201 bp, Bos taurus; identical to SEQ ID NO: 30488

SEQ ID NO: 111423 - DNA, 201 bp, Bos taurus
aagggcccctggttggggtactctctggatagacacatctcccagcaatggtgagggattcaggctcctcccgtcctgggggctgccacctgaccacccayggtctctctggccttgtgttccagtttcctcactttgccacaaaggctgacctgtccatagctggctctgccgagggttctacacttaaagcgtctctac

SEQ ID NO: 111424 - DNA, 201 bp, Bos taurus
cctgggcccacctgggctgagtctgaggatctcggggaatatctgggcagggatccaggaggcaggtggatttatgagtaagggcttagctcacggggccrcgtgtggacactgatttggagtacagccgacgcgctcattaacatctctgggaacatgccagcgttcacctggatgtgtgggcctgtttgttcctttgcc

SEQ ID NO: 111425 - DNA, 201 bp, Bos taurus; identical to SEQ ID NO: 70271

SEQ ID NO: 111426 - DNA, 201 bp, Bos taurus; identical to SEQ ID NO: 30492

SEQ ID NO: 111427 - DNA, 201 bp, Bos taurus; identical to SEQ ID NO: 30493

SEQ ID NO: 111428 - DNA, 201 bp, Bos taurus; identical to SEQ ID NO: 30494

SEQ ID NO: 111429 - DNA, 201 bp, Bos taurus; identical to SEQ ID NO: 30495

SEQ ID NO: 111430 - DNA, 201 bp, Bos taurus; identical to SEQ ID NO: 30497

SEQ ID NO: 111431 - DNA, 201 bp, Bos taurus; identical to SEQ ID NO: 70279

SEQ ID NO: 111432 - DNA, 201 bp, Bos taurus
caaagagtcggactgagcaactgaacaaaaacaaccctcaggctagcctaagaaatcgtccgtttttcactgttactcttgtttctttggtgttatttttyctcacaggctctcaaagtagtgattccttcaattctccaagtagtcctaacacttagcagggtttactgaggctttagtgaaacagaaggaaaagttcag

SEQ ID NO: 111433 - DNA, 201 bp, Bos taurus
ttttgcctgccagggccctggagcccctaggtgaaggacagtaaggatccttcagcctaagctcaccccatataagcctgtgcatccaactaggactgcaraagggtctgcccacaggcagggccctgctgagggtatggctggtgccctcagaggcaaagcagcagcagaatggtgtgggggaggggagaagcaaggatt

SEQ ID NO: 111434 - DNA, 201 bp, Bos taurus
gagtgctcagctacttgctggcccttggtttttagttttgatatcagttttcagaatttatttaaaggaacatgcaagcatgggaactacaaccactaatracagtgagagagggtgttcaacaggcccctcctatggcctctgtgtcctgcgcccatcgtggggagcaagtgccacacggagagcaaggactggacctga

SEQ ID NO: 111435 - DNA, 201 bp, Bos taurus
gatgatgtgggctggggcaggtgcgacctagtaggcagggcaccaggcaggggtggcatggaggggcttgtgtccccacgagtctgggggccctgtgcctygcctctcctgcccctgaaactgttaaactaattaaggctgtggagccgcaggattaatcggggcagctcggcgcgggccaggagctcaggtagtcgatta

SEQ ID NO: 111436 - DNA, 201 bp, Bos taurus
caatttaactttaattgtatgtaaattagactcctgaaatgcttaaaaacagctcattaaacatttctccctgcaatcttatttacaccattttcttagcmaggcttttctttattagagtgcagaggttaactttagctcagatctgagtttatctcaagtttcaaatgggtatggagtctatgttaataaagtgttgcc

SEQ ID NO: 111437 - DNA, 201 bp, Bos taurus; identical to SEQ ID NO: 30503

SEQ ID NO: 111438 - DNA, 201 bp, Bos taurus; identical to SEQ ID NO: 30505

SEQ ID NO: 111439 - DNA, 201 bp, Bos taurus; identical to SEQ ID NO: 70285

SEQ ID NO: 111440 - DNA, 201 bp, Bos taurus; identical to SEQ ID NO: 30506

SEQ ID NO: 111441 - DNA, 201 bp, Bos taurus; identical to SEQ ID NO: 30507

SEQ ID NO: 111442 - DNA, 201 bp, Bos taurus; identical to SEQ ID NO: 30508

SEQ ID NO: 111443 - DNA, 201 bp, Bos taurus; identical to SEQ ID NO: 30511

SEQ ID NO: 111444 - DNA, 201 bp, Bos taurus; identical to SEQ ID NO: 30512

SEQ ID NO: 111445 - DNA, 201 bp, Bos taurus; identical to SEQ ID NO: 30513

SEQ ID NO: 111446 - DNA, 201 bp, Bos taurus; identical to SEQ ID NO: 30514

SEQ ID NO: 111447 - DNA, 201 bp, Bos taurus
ccaggcacaggaaaagcaagccaacctgagctgcactgcgctcaattcagctcagactgggctcaagcagccatgagcaaaaatagcttcggatttcaccmgcaaggacactttagcaggcctggctgagcagtaagctccccgcccctggacgtattcaagttgagattttccctctggagaaggtcagaattcatgttc

SEQ ID NO: 111448 - DNA, 201 bp, Bos taurus; identical to SEQ ID NO: 30515

SEQ ID NO: 111449 - DNA, 201 bp, Bos taurus
tgcctcgagtggccatctgtgaggctcagagccacccagaatggtcaattccctggcaatcgatacagagttagggctaagaagaggtatatcagttccayagcacactaatttggcctgtaacctgaaaaagtgaaatgaatctctggtgaaccagattctggtataaaacatgtcagggatcaatatttctggcttgtc

SEQ ID NO: 111450 - DNA, 201 bp, Bos taurus; identical to SEQ ID NO: 30516

SEQ ID NO: 111451 - DNA, 201 bp, Bos taurus; identical to SEQ ID NO: 30517

SEQ ID NO: 111452 - DNA, 201 bp, Bos taurus; identical to SEQ ID NO: 30520

SEQ ID NO: 111453 - DNA, 201 bp, Bos taurus; identical to SEQ ID NO: 30521

SEQ ID NO: 111454 - DNA, 201 bp, Bos taurus; identical to SEQ ID NO: 30522

SEQ ID NO: 111455 - DNA, 201 bp, Bos taurus
ataatttatgtccttctccttcctgctgtgtcaacttggggttacataactgaacttctctgtgagggagcccttgggggcctccaggaggcagggttggyggtgacataaataaatatttctctgctctctgccccgggcttgggctctgagcaaacaccacagcctgaaagggaggccatgacaaggaggaagctgggg

SEQ ID NO: 111456 - DNA, 201 bp, Bos taurus; identical to SEQ ID NO: 30523

SEQ ID NO: 111457 - DNA, 201 bp, Bos taurus
cgattcagcatgcacaaagctgttaaagaagaaacagtggaaccctatcaaacaatgactcggatctgcgtggtctacggcctgctactggagtggactcrctctcgacaggacactggggatcagtgctcaccttgtttgacccccttcccagccctgagatctgggtgttctctgaggcccatgtttaggggaccatgt

SEQ ID NO: 111458 - DNA, 201 bp, Bos taurus
tgaattgttttccacagtggctgcaccattttacactctcaccagcaatgcacaaaggttccatagattcacattttattatatgcttttgcgatgtgagrctgtcccggcatgaataaaatagacaagtccatgcttttaagaaacagacattcagcagagggagttgggtaatacacaaataaatattaatcttttgat

SEQ ID NO: 111459 - DNA, 201 bp, Bos taurus; identical to SEQ ID NO: 70302

SEQ ID NO: 111460 - DNA, 201 bp, Bos taurus; identical to SEQ ID NO: 30529

SEQ ID NO: 111461 - DNA, 201 bp, Bos taurus; identical to SEQ ID NO: 70306

SEQ ID NO: 111462 - DNA, 201 bp, Bos taurus; identical to SEQ ID NO: 70307

SEQ ID NO: 111463 - DNA, 201 bp, Bos taurus; identical to SEQ ID NO: 70308

SEQ ID NO: 111464 - DNA, 201 bp, Bos taurus; identical to SEQ ID NO: 30532

SEQ ID NO: 111465 - DNA, 201 bp, Bos taurus; identical to SEQ ID NO: 70311

SEQ ID NO: 111466 - DNA, 201 bp, Bos taurus; identical to SEQ ID NO: 30533

SEQ ID NO: 111467 - DNA, 201 bp, Bos taurus; identical to SEQ ID NO: 30534

SEQ ID NO: 111468 - DNA, 201 bp, Bos taurus
gccccagagtggagcctggagggcgtttgtcacatcccacaccgccatgggtgtgtcttccttcagacaccggcttttggacccccttggggtttctgggraggagtcctgtcccgcctgatggcctagcaggggtgcccgcaggccctagactcagatttgggtcagattcccagttcagccactttgtggggagctctt

SEQ ID NO: 111469 - DNA, 201 bp, Bos taurus; identical to SEQ ID NO: 30537

SEQ ID NO: 111470 - DNA, 201 bp, Bos taurus; identical to SEQ ID NO: 30539

SEQ ID NO: 111471 - DNA, 201 bp, Bos taurus; identical to SEQ ID NO: 30540

SEQ ID NO: 111472 - DNA, 201 bp, Bos taurus
ggtgttgatgatatatttagcccagagagagtgaaataaaattgaaaaaggaaagccttcacaacatgtgaggttatgtaagatcacatctgggtaaatcrtttcctgcttgggtcgtttctatgaggcaatgagctccctggtagaaagagatgggtcagtgtcctttgctaccagcagagcgcatagcagaatgtctta

SEQ ID NO: 111473 - DNA, 201 bp, Bos taurus; identical to SEQ ID NO: 30541

SEQ ID NO: 111474 - DNA, 201 bp, Bos taurus; identical to SEQ ID NO: 30542

SEQ ID NO: 111475 - DNA, 201 bp, Bos taurus; identical to SEQ ID NO: 30543

SEQ ID NO: 111476 - DNA, 201 bp, Bos taurus; identical to SEQ ID NO: 30544

SEQ ID NO: 111477 - DNA, 201 bp, Bos taurus; identical to SEQ ID NO: 30545

SEQ ID NO: 111478 - DNA, 201 bp, Bos taurus; identical to SEQ ID NO: 30546

SEQ ID NO: 111479 - DNA, 201 bp, Bos taurus; identical to SEQ ID NO: 30547

SEQ ID NO: 111480 - DNA, 201 bp, Bos taurus; identical to SEQ ID NO: 30548

SEQ ID NO: 111481 - DNA, 201 bp, Bos taurus; identical to SEQ ID NO: 30549

SEQ ID NO: 111482 - DNA, 201 bp, Bos taurus; identical to SEQ ID NO: 30550

SEQ ID NO: 111483 - DNA, 201 bp, Bos taurus; identical to SEQ ID NO: 30551

SEQ ID NO: 111484 - DNA, 201 bp, Bos taurus; identical to SEQ ID NO: 30552

SEQ ID NO: 111485 - DNA, 201 bp, Bos taurus; identical to SEQ ID NO: 30553

SEQ ID NO: 111486 - DNA, 201 bp, Bos taurus; identical to SEQ ID NO: 30554

SEQ ID NO: 111487 - DNA, 201 bp, Bos taurus; identical to SEQ ID NO: 30555

SEQ ID NO: 111488 - DNA, 201 bp, Bos taurus; identical to SEQ ID NO: 30556

SEQ ID NO: 111489 - DNA, 201 bp, Bos taurus; identical to SEQ ID NO: 30557

SEQ ID NO: 111490 - DNA, 201 bp, Bos taurus; identical to SEQ ID NO: 30558

SEQ ID NO: 111491 - DNA, 201 bp, Bos taurus; identical to SEQ ID NO: 30559

SEQ ID NO: 111492 - DNA, 201 bp, Bos taurus; identical to SEQ ID NO: 30560

SEQ ID NO: 111493 - DNA, 201 bp, Bos taurus; identical to SEQ ID NO: 30561

SEQ ID NO: 111494 - DNA, 201 bp, Bos taurus; identical to SEQ ID NO: 30562

SEQ ID NO: 111495 - DNA, 201 bp, Bos taurus; identical to SEQ ID NO: 30563

SEQ ID NO: 111496 - DNA, 201 bp, Bos taurus; identical to SEQ ID NO: 30564

SEQ ID NO: 111497 - DNA, 201 bp, Bos taurus; identical to SEQ ID NO: 30565

SEQ ID NO: 111498 - DNA, 201 bp, Bos taurus; identical to SEQ ID NO: 30566

SEQ ID NO: 111499 - DNA, 201 bp, Bos taurus; identical to SEQ ID NO: 30567

SEQ ID NO: 111500 - DNA, 201 bp, Bos taurus; identical to SEQ ID NO: 30568

SEQ ID NO: 111501 - DNA, 201 bp, Bos taurus; identical to SEQ ID NO: 30569

SEQ ID NO: 111502 - DNA, 201 bp, Bos taurus; identical to SEQ ID NO: 30570

SEQ ID NO: 111503 - DNA, 201 bp, Bos taurus; identical to SEQ ID NO: 30571

SEQ ID NO: 111504 - DNA, 201 bp, Bos taurus; identical to SEQ ID NO: 30572

SEQ ID NO: 111505 - DNA, 201 bp, Bos taurus; identical to SEQ ID NO: 30573

SEQ ID NO: 111506 - DNA, 201 bp, Bos taurus; identical to SEQ ID NO: 30574

SEQ ID NO: 111507 - DNA, 201 bp, Bos taurus; identical to SEQ ID NO: 30575

SEQ ID NO: 111508 - DNA, 201 bp, Bos taurus
gatggtaggacttctgtgtgtgtatgtagtttttttgtttttgctttttggagtttttttttttttgccttattcaggaaaataaaaatttgttgaccctrtatgagtccaaaaaaacttgctgatctgtgaaattcaggggtctgagaaccactgcaatagaagctttccccaaaaggctaagagagtcttggcatgcag

SEQ ID NO: 111509 - DNA, 201 bp, Bos taurus
cgtgttctccctacagttttccagtaaaagccagatttctgctgctttgaaattctgtcagagtagctcagaggtgcagcctgggggccttaggagccacrcttggctgcagtgtccttggaacgctttcacatcgagcctcgaaaacccgcttctggtggtgctagtgaggcccacagctaggggcccagaggccatttg

SEQ ID NO: 111510 - DNA, 201 bp, Bos taurus
gccccgcgggctccctagaggctgcaccagggcctcccgcagaccggggtgcgggggacgagggaccgggaggaggctggctttgacggggaagccgaggrtttcacagacaggctccttgacccgcctccagattcgaccagtacgtgcacacggacgtgcccgagcgggacctcgcggccttccggcaggcctggccac

SEQ ID NO: 111511 - DNA, 201 bp, Bos taurus
gaggcagtggccccgcctcgaggggagtcaggcagccaggctgcagctggctgggctcccgcctctgggatctcctcctggccccagccctgacccctggytgccctttcaggttcctgcaggacctggagcagcggctggaggcagacgtcctccgcttcagcgtgtgcgacgtggtcctgcagcactgtccggccttcc

SEQ ID NO: 111512 - DNA, 201 bp, Bos taurus
acctttaataagcttgacaagaaaagccacaggtaaatattctctgtatagggaaaaggacagccaaagtttgaataaattacagagaaagtttcaaaagkttgaccaaaaagttcaatctaggggacttccctggtggtccagtcattaagaatccatcttgcaatgaagggtcacaaattggaaccatggttggggaac

SEQ ID NO: 111513 - DNA, 201 bp, Bos taurus
ttggttttctcatactgttagccccaaactgaaaaggtgtgtcagtttaggttttccctgggtgccagctctcaccaggccactgcaatactttctgcctrtgaaggctcgttagcagattaccatggcgttccctgaggaattgagatctctggcctccctgagggttggcaggcagggccacctcatggtgggtaggtc

SEQ ID NO: 111514 - DNA, 201 bp, Bos taurus
ccttggaaatagaaagtctcacaaacaaaaatcatatgcttattcttaagctggtgaatgattcttttcatgttcttaagaagtaaaatttcttaaacttyctatctttagaacaaaaaagtcaacatactcattcctccaaattctggaagtaagataaatggccagggatgaagagcccttagaaaggtacagaaataa

SEQ ID NO: 111515 - DNA, 201 bp, Bos taurus; identical to SEQ ID NO: 30577

SEQ ID NO: 111516 - DNA, 201 bp, Bos taurus
gtaatgtcccagatgcatttgccctctgtcttccccaaatatctgtcagcacaatacctgtaggtctttgaataagaacaaatctagttttactcttgtgrtctatgaaggggctcactcactttggttttcatgtaatttgtgctaagttatcatatatacctttaggctaccaaagcactagtgaatgcttctccagga

SEQ ID NO: 111517 - DNA, 201 bp, Bos taurus
cgctgcaacaagccacagcagtgagaggcctgagcgccacagctgcagaggagccccggctcaccacaactgagaaagcccttgcacgacaacgaagatcyggtgcaaccagaaataagtaaaaggactgcaaaataataataaagttgaaagggtaagctgagaggctggcacctcatcctgtgagcaaatgggcaacac

SEQ ID NO: 111518 - DNA, 201 bp, Bos taurus; identical to SEQ ID NO: 30578

SEQ ID NO: 111519 - DNA, 201 bp, Bos taurus
aagatggattggatatcagacatacctgatcgtcacaaagaaacatcttttcccatagctcttctgtgggagacaaaaatcataagttggcctccaagatytccatactttggtgtatatgcctctcattagctccttgatgatgtaaaggacatgtgactatgatgagatagcactcctgtgattatattattttatcct

SEQ ID NO: 111520 - DNA, 201 bp, Bos taurus; identical to SEQ ID NO: 30579

SEQ ID NO: 111521 - DNA, 201 bp, Bos taurus
catcaagggcaagcagctctttcgtgaggtccagaacagaaaactggccacagacaggcagacagacgtacacacacacacacctttcaaaggtctccacrttctatttttcttttatatcactgttcatagtgctggaagtttcatccatggaatttatgttgactgctgctagaagcctggacaactcaaaactgatac

SEQ ID NO: 111522 - DNA, 201 bp, Bos taurus
ctgccagagataaaagtacaattcctttcctcaagagaactttaggttattgggcattcaccagtgtgggttagtatacagtgtgaaatccacataaatcrggggatctcagagtagatgcatctgacaactcagacacgtgtagaagccagtggtaggagggaaagggggactcttgaacaaccactggcttcccggctg

SEQ ID NO: 111523 - DNA, 201 bp, Bos taurus
caagttaaattcaaactacttttttttaagacatatattaatggaagcttcctagaggtagaagagagagttgatgtatatttgggataggaagtgcaggrgggagagagagagagagagagagagagaagagagagagagagagagattctctttctacccctgccccaggctctccagacactttgattgagaagcttt

SEQ ID NO: 111524 - DNA, 201 bp, Bos taurus; identical to SEQ ID NO: 30581

SEQ ID NO: 111525 - DNA, 201 bp, Bos taurus
ttgccagaaatctcacagttcagaccaaaatatcaatacttgggcccaatctcctatgtacatagggatctcttaaaatcattctgggggcctggagtccygaggagtagacagagttgccagtgctgtccttatcttctgggtaatggcacaatccttcccgttctgctctagtaggaagacttagaagtgaaggcctga

SEQ ID NO: 111526 - DNA, 201 bp, Bos taurus
cccgtgccctgacctctgtacatgctcttctctccttctctcacctcttccctttttttcttgtggttccctcctgcccatcctccaatgtcagctcaaakggcctttcctcaggacaacctctcctcatccccaaatcctctgttatatcctgtcattgactgtgtaccactggttacgatgatggttttacatttatct

SEQ ID NO: 111527 - DNA, 201 bp, Bos taurus
gaatgcacataggttaggtgaccaccagagccccgctggtggccagttgcagcatcctaagttgcgactccaggatgggatgcctgaggcccactgtgctygctctcagctgcagcatccccggggaaggatgagagcacaccaccctctggtggcggcagagcagacatcagccaggccaggcagcgcagtgtacccagg

SEQ ID NO: 111528 - DNA, 201 bp, Bos taurus
aaaagccatctgctggcactaggccagtatgtctgaattttgtcattattagcatctcatttttccaaaaaaggaaatgtgtaagtagcacgtgtacatamatggccatttctacaaagccttctctgcagtcttgacctgtgtgaggacaggttctactgatggaagcatttttagaggcagaaggaaaaacattaactt

SEQ ID NO: 111529 - DNA, 201 bp, Bos taurus; identical to SEQ ID NO: 30585

SEQ ID NO: 111530 - DNA, 201 bp, Bos taurus; identical to SEQ ID NO: 30586

SEQ ID NO: 111531 - DNA, 201 bp, Bos taurus; identical to SEQ ID NO: 30587

SEQ ID NO: 111532 - DNA, 201 bp, Bos taurus; identical to SEQ ID NO: 30588

SEQ ID NO: 111533 - DNA, 201 bp, Bos taurus; identical to SEQ ID NO: 30589

SEQ ID NO: 111534 - DNA, 201 bp, Bos taurus; identical to SEQ ID NO: 30590

SEQ ID NO: 111535 - DNA, 201 bp, Bos taurus
gctggcaaccctctgtggatgagccacctctgtctgcctggctcccgtccacactggggcccccccccaccgggtggaagtatggcagagggcccagctgyggtcagccacacctgcccacctcaagcacagagaagaccactaagaaaagatgagaaaactatggtgtcagaaaccatgggccagagctatgaagcagcc

SEQ ID NO: 111536 - DNA, 201 bp, Bos taurus
aagagttagtgtccttcattacctatctctatgaaatgaactctttctttaatatcctgcagcagtatttcccaaaatatgtgccttggaacagtggtttkgggaggaaaagaggtgttggaaacaagtaagtttggaaaaacctgtgtactatcctctgttcccactttaacttctaggcgggagtgacagggcacatta

SEQ ID NO: 111537 - DNA, 201 bp, Bos taurus; identical to SEQ ID NO: 30592

SEQ ID NO: 111538 - DNA, 201 bp, Bos taurus
gaaaaaagtaaggcatggaccgtgtcttcctggcaccagccccacacttccagctgatgattaaataccatcacttaaataacacttgggtgttccacagkctttgccaccttctgaattctgtttctattgataatatgacggtcttctcagacatccagaatgcatactttgcgatgatctttaatgtccccttttcac

SEQ ID NO: 111539 - DNA, 201 bp, Bos taurus
cagagcatgggctttgggccaggcagtctgggctcagcagctgtgctgtttcttgtcatcttgtgagctggttacttagcctctctgagcatcacgaaaaygaggtaccaatggccaaccgactgagttgctatgaggattactcccattagatgtgtcatgatgctcggcacacggtaaggcctcaggagcggtggctgc

SEQ ID NO: 111540 - DNA, 201 bp, Bos taurus; identical to SEQ ID NO: 30593

SEQ ID NO: 111541 - DNA, 201 bp, Bos taurus; identical to SEQ ID NO: 30595

SEQ ID NO: 111542 - DNA, 201 bp, Bos taurus; identical to SEQ ID NO: 30596

SEQ ID NO: 111543 - DNA, 201 bp, Bos taurus
aggctggctatttattcccctggccccgttcctgtgcagtcctgacatgctagctttgtcctttgaccaaagctttagctgctgtcagatgtcttttccayacagctttcttgggggcctgtaactgctcctcctcactcaatccctgagctttgaggtggaccagctccctgaagctccctgccgtgggctgctgtgcca

SEQ ID NO: 111544 - DNA, 201 bp, Bos taurus
agaggagagcattcaaggcctcgtttgaagtatcctccaagccgtgcaggaaggtacagaggggaagaagggaagaaaggggataaggcccctcttctctrtgtgtaccctggactctggggtgtcgatgggcacctggtggggatcggggtgggagtgctgttcagacagtctgggcgggtggccttgagccccattgga

SEQ ID NO: 111545 - DNA, 201 bp, Bos taurus
aaagttcttttggaaagcataacttttggcagagtcaccttgcaaatctataaatgaatggcaaagtcaatccatgtttataagcatatatttttagttgrtaggaatattatatatatgtaaataccttttatgatggccattccccaaattctttaaaaataatattacattgatgatattgggtgccatagtccttcc

SEQ ID NO: 111546 - DNA, 201 bp, Bos taurus; identical to SEQ ID NO: 30600

SEQ ID NO: 111547 - DNA, 201 bp, Bos taurus
tttcttattgtagactcagtgagagtaaagataaagcaactgtcaaaatagcatgttattttgacagtagccatatcataaccataaatgatacagtttayctgtacatttttaccctcactaatggggtctaaatactgtattctccgatatttcatacatacgcaaagatacatgcacatgggttttagtaagaaaggc

SEQ ID NO: 111548 - DNA, 201 bp, Bos taurus
attctggcctggggaattccatggactgtatagcccatggggtcgcaaagatctggacacgactgagcgactttcactttcaccagttgaagaagggatakaaattaggccaagaatctgaactgaagtgtccaaatgggtgtgacagtcatcagatgagcctgacatgacgatcttatgcaaggaaagggaaaaaaaaaa

SEQ ID NO: 111549 - DNA, 201 bp, Bos taurus
ccaggaggggtatgggatggtatgctcaccctctttctcttgctgccagataatactttccttcagaattcagctccaaacactcccaatgctccatacaygcaactctgacccaggaggcccaggcaggaagccccttcagaatcgaccctgagcagatgacctcactgagaagcgtcgcgtgcaaggtgccggtcagag

SEQ ID NO: 111550 - DNA, 201 bp, Bos taurus; identical to SEQ ID NO: 30603

SEQ ID NO: 111551 - DNA, 201 bp, Bos taurus
cagaaatgttaagtccaagctaatgttttgtgtaaatcctggaagggcattgtcaagtcttattttgtagtcactagctccaaacaaagggccttttccartttcactatttccactcacctttttcaataatgtcaagatgatacagtatagactttagcgtggcctccaaacacataactatatagttgatttcttttg

SEQ ID NO: 111552 - DNA, 201 bp, Bos taurus
caacgtggtctgacactacagacagagaagagatgggcctgattgaaaaaaaaaaaaaaaaagacaggacacattttcttttgcaagaaaacaactattgrgtctgtgataaacagaataatggccttgcaaagttgtccatttcctaatccttggaacccacggattacatggcaagaagaaattaagttttaaaatgca

SEQ ID NO: 111553 - DNA, 201 bp, Bos taurus
agaaatggtatgtaaaaaagtatcaatatattgtaatatagtaaatgtaatatgtgcactttaattttagtgtaccctagcatgtggatgtgaatactttkctgaagctggtagttgaatgaagccctcctttagaagtttaataataataagattagcaatgataaaatttaacatttaatagactcttagtgagataaa

SEQ ID NO: 111554 - DNA, 201 bp, Bos taurus
attgatttccacattcattcctaatttgtaaatcacagattttcctgggtgaggcctctaagcagtctgatcattttgctcttttaggagctttgttttargagcacagggtgagagatggaggggccctgagagagagttcagcagccaccttttaaaataaaggaagtggggaaaaaagtctctctatttctcccaatt

SEQ ID NO: 111555 - DNA, 201 bp, Bos taurus
agattcaattagtttaaaacatgactgatttgcaaatccaggaatatatttcataaaataatgtacattcaagtatctactttatgtcttaggacagatgygtgatgtctagtcctatgatatatacataaaacacaaagatgcaagggttagctgttagaaccagagttcagaggatccatgtagcctaggtgatatttt

SEQ ID NO: 111556 - DNA, 201 bp, Bos taurus
gctcatagcatctatactcctaccaaactaagataattaactaaagtagggttttgtaagcccaaggaaagagacagccattccttataataacatacttygtttttgccacagagggtgctctgggaaggggcctatttttggttcttcttccaccctacatcctgcacaggatctgaggctccctcacgtcctgtcagc

SEQ ID NO: 111557 - DNA, 201 bp, Bos taurus
gccatcaccttaccagagatccaagtactcaaggccctgtatattttggccattgaaatgataaattattgaaaaaacagaaactaatttcttttccatgyttcagttctatgtcccaaacaaaagtacaataaattaaaattgaatgaaaattgtgataaagcctcatgtctaatgaatttgagatgagaaggaattatg

SEQ ID NO: 111558 - DNA, 201 bp, Bos taurus; identical to SEQ ID NO: 30605

SEQ ID NO: 111559 - DNA, 201 bp, Bos taurus
agctcattgtcataggtgctatcattaataatccttatgaccatgattacaatgccatctactcagtgtgctggggagagagaagcataggcagcagacartaggaaccagatcctgtgggatgcaaggaatattcactgtattgtactatcgctcacactggctttcagacagagtcccagcgaggtgatactggaattc

SEQ ID NO: 111560 - DNA, 201 bp, Bos taurus
aaaaattcaaattcattaccataaaaatgagcctcttctctgtcacagcttacaattctctctgacattcaattgactgatcagcagacctgggctttatrgtaggagactttttgcattcctctttgatctgatttccccctatttaatagacaattataggctctttaaatcccaaaggttcagagagagcaaataatt

SEQ ID NO: 111561 - DNA, 201 bp, Bos taurus; identical to SEQ ID NO: 30609

SEQ ID NO: 111562 - DNA, 201 bp, Bos taurus
agtaagcaagcagtttgttttctttcttaagaatatgaagcacagataacaataaaactctgttttcagctggatatgacagcaatcatcttcaaaggctyccacatcacataagactcagcacatttgtaatcatttttctattgttgattagaagagagtattctacagtttagctgttctttgtacacatgattgata

SEQ ID NO: 111563 - DNA, 201 bp, Bos taurus; identical to SEQ ID NO: 30611

SEQ ID NO: 111564 - DNA, 201 bp, Bos taurus; identical to SEQ ID NO: 30612

SEQ ID NO: 111565 - DNA, 201 bp, Bos taurus; identical to SEQ ID NO: 30613

SEQ ID NO: 111566 - DNA, 201 bp, Bos taurus
gtttctccaaagaagacatacagatggctaataaactgtgaacttcttaaaggtaggatcaatgactttactatatttgaatccctaccaaattccttgcrtgtagtaacagttgataagcaaagatttactaaactaaactgaattcaattgatctctgctttcctctgagccttgatttatggcagttgggtgtggcta

SEQ ID NO: 111567 - DNA, 201 bp, Bos taurus; identical to SEQ ID NO: 30615

SEQ ID NO: 111568 - DNA, 201 bp, Bos taurus; identical to SEQ ID NO: 30616

SEQ ID NO: 111569 - DNA, 201 bp, Bos taurus; identical to SEQ ID NO: 30619

SEQ ID NO: 111570 - DNA, 201 bp, Bos taurus; identical to SEQ ID NO: 30621

SEQ ID NO: 111571 - DNA, 201 bp, Bos taurus
tggcatgaaaataagctatgcgttttaccccatttagtctaacatttgtaacattcagaagtggtcatataaacattttcttttgcatgagtgactaattrtcttatacattcttcactaataagagtaaatgcttgatgaaggagagagaaaagaatagaaagtctcagtcacatagattcaaacattccacatgtaatg

SEQ ID NO: 111572 - DNA, 201 bp, Bos taurus; identical to SEQ ID NO: 30622

SEQ ID NO: 111573 - DNA, 201 bp, Bos taurus
atctgctgtattgaaggtggaagaataagagttaggagtaaatggaagtgtgaaaaatgctgcctgtgtgaggattacagggagtaaagaagatattgatsaatttcctactccagtggtgaataagcacacagtacaaaagaaatattgaaaatattaaaaacaggattctggttaattagaagatacagtcttacagtg

SEQ ID NO: 111574 - DNA, 201 bp, Bos taurus; identical to SEQ ID NO: 30636

SEQ ID NO: 111575 - DNA, 201 bp, Bos taurus; identical to SEQ ID NO: 30641

SEQ ID NO: 111576 - DNA, 201 bp, Bos taurus; identical to SEQ ID NO: 70435

SEQ ID NO: 111577 - DNA, 201 bp, Bos taurus
ggcaggatgagaggaaaatgcaatcatcccggggagaaacagcagcctggatcaaggctgaggcaggggctgaaaaccggcacagggaggccacccttgcyggctttctccacctgactttccccttttgtaagatcttctcttggatcctagagaagactcctaaaaggggaggggccggtccctgcctagggtggggag

SEQ ID NO: 111578 - DNA, 201 bp, Bos taurus
actagaacccaggcttcctgattcttctgtttagtgctctgttctgtaccccactctactaactcttctccatgggaaatgtctgagatttcctcagatargaaatctggctgctttccagagttctgttgcatgggggcctgggtgctggttcccttcctccagatcccagcttagccctgttcccctaactggtctggg

SEQ ID NO: 111579 - DNA, 201 bp, Bos taurus; identical to SEQ ID NO: 70437

SEQ ID NO: 111580 - DNA, 201 bp, Bos taurus; identical to SEQ ID NO: 70438

SEQ ID NO: 111581 - DNA, 201 bp, Bos taurus; identical to SEQ ID NO: 70439

SEQ ID NO: 111582 - DNA, 201 bp, Bos taurus; identical to SEQ ID NO: 70442

SEQ ID NO: 111583 - DNA, 201 bp, Bos taurus
gaggagaggaggggggaccttgtcagttggagggtgcccctgcccttctcagatctgcctctgactggggtcagcattcacatcactctctggccttcttyatttgttctacaccttcccgtggagtcccaaagcccagctcacagcccgccctgagcactgttcttaggtcctcctcccacagggactggccaactttat

SEQ ID NO: 111584 - DNA, 201 bp, Bos taurus; identical to SEQ ID NO: 30644

SEQ ID NO: 111585 - DNA, 201 bp, Bos taurus; identical to SEQ ID NO: 30645

SEQ ID NO: 111586 - DNA, 201 bp, Bos taurus; identical to SEQ ID NO: 70446

SEQ ID NO: 111587 - DNA, 201 bp, Bos taurus; identical to SEQ ID NO: 70447

SEQ ID NO: 111588 - DNA, 201 bp, Bos taurus; identical to SEQ ID NO: 70450

SEQ ID NO: 111589 - DNA, 201 bp, Bos taurus
tgtttttacgtcctcactgaaactagagaaatatttctgaaacaaaagtataattatatagtatttcatgcttgaaagagttcagtgacttcccatttcarttcagttcagttgctcagtcaagtcccagtctttgcaaccccatgaactgcagcatgccaggcctttctgtccataaccaactgccagagtctacccaaa

SEQ ID NO: 111590 - DNA, 201 bp, Bos taurus
aataaaataaaatatttgagccactctaagaaaaacatgacagaagtaaactgtagcaagttcatagaaaatgagaacaaagaatatggaaagaaatgcartatagaagctataggtatgagagaactgtcagaggttcaaaaaattataattttgtgctcttacagtacctaaaaataaaaataaaacctttaattcatc

SEQ ID NO: 111591 - DNA, 201 bp, Bos taurus
ttcttcaaaatgcatatgtgcctacattggctattatctttctaacatcaatttattcttctaggcatgtattaacatggaataaatctttggtatgaggraatgagccctgatagaaaaactagcacaggagatagagagcatgacattaattaaccttgtgatgtgatattgatcccactcatgtaacttcactgaatc

SEQ ID NO: 111592 - DNA, 201 bp, Bos taurus
catgtaagtatatgtatattccctcctggctctgcttccgtgactcaattactcccaggttggagatgaacacaactaattacgtctcttagaagaatcayatctttcttttaacaagtactcagcaaacaatagaatggtaagtcgcaccttcaagttagccaaaaattgtcaattataaactataattatcagttttag

SEQ ID NO: 111593 - DNA, 201 bp, Bos taurus
aaacgaggaggcctacactaccaatgagctaaaagaatgcagaggaggaggagcagagggcagagatgtgctggtggatgtgcaaactagctcaaaacaaygcctgatttgtagcaatggcctaattctgtagtgtgtaaatgcccctaccattgccaattacaaactgctttaccaacttcaagtgtgatcactgaaagc

SEQ ID NO: 111594 - DNA, 201 bp, Bos taurus
cactgctgctgtaaccaaatccttgggggccatcttcctgcccttccccaagtgtcactagttcctgaaacaggctgctgtggctagaacctagggtcacrgctgcactctagcttcaaggccatctgagaaagtcaatagctggtctttgggtatcttttacatcaagagaacatgtttgcaaagacacattgtttctcc

SEQ ID NO: 111595 - DNA, 201 bp, Bos taurus
agtaacaaaatatgcagagttgccacagtccaggtttatatagcttatttaatgttgggatgagaattagaaactccttttatatacttttcaagcacttkatcaggattttttactaggcagattacccaaaggtctctagaaatcttatcttaatgggagtagccacagtctttgaatgagttcagttattgaacgtgt

SEQ ID NO: 111596 - DNA, 201 bp, Bos taurus
acataaattatgtacatttaacatatactagttgtacatttcttaggctatcagcgaatgagattttaaaaacaaaaaaaaactgctgaatacttgtctgmatatttttgtctcagagttcagtaactcaaaccctgcaaaattagtttcataaggccgtattgtgaatataatatgtagttcatatgtttctgtagtgca

SEQ ID NO: 111597 - DNA, 201 bp, Bos taurus
aagtgacagcaatgctctggcagatgcaggagattatgaggcattagtcaacagtttgggggagatgtactggtccagtgaaggacatcttggaagcacayggacagcaccctctatgccatttctgagacagaatttcaagccatgcttgcaaagcataatgccatctactaatttggggccttttcctccatttgcatg

SEQ ID NO: 111598 - DNA, 201 bp, Bos taurus
aattctgtcaaggagtagaatagaaaacagaaacaactctaggcattctattcaaaaagagaaattaaatatagggagccaggcacttaaaaagtcgtggsaagtttggactccaggctgggtctcctgaaatgatccctgataaagtgcagaactgatctgagagggagctgttcattatcctaagatcagaaatgtggt

SEQ ID NO: 111599 - DNA, 201 bp, Bos taurus
tgctgaatcttttttcaaattcataaagaaagtctctcaggatatttcacagtgtgagtatacacagcctcctttccctgacaggtcattattgaatatcrtgctgggtttgagtacagggctggtgagtggcttctctccctgcttcttctgtaaatgtatgaggggttcaagctttggaatcttaaatgtccatgagag

SEQ ID NO: 111600 - DNA, 201 bp, Bos taurus; identical to SEQ ID NO: 70555

SEQ ID NO: 111601 - DNA, 201 bp, Bos taurus
aagaaagactcaccttattcttctccatccaactctctcctatttctatattatttgagtctatccaaactattcatttgtggatatttagcagactattytgcttcatgtacagatgaatagagcttggatttataaaatacacttactatttgggaaaagatcatcaccaaaaaaatactaaagtgttacattagtaat

SEQ ID NO: 111602 - DNA, 201 bp, Bos taurus
ctttatgcacttcatatgtttctagagatcttcccccaaatagtcttctagttagttccaaaattttgtgattctgtgcacttcactgaacaaacacatamttaatcttaaattatgcagttacagactggtattgataattatagtagtattgtaaagtgatttctatattgacaaaatagatatattttaattgggggt

SEQ ID NO: 111603 - DNA, 201 bp, Bos taurus
ctgaacccaccttcttcctccctcctcataccatccctctgggtcgtcccagtgcaccagccccaagcatccagtatcgtgcatcgaacctggactggcayctcgtttcatactttgtgtatgtatttgattgaaagtcaaagtgaaagtcgcttagttgtgtctgactctttgtgacccatttgattatattcctataat

SEQ ID NO: 111604 - DNA, 201 bp, Bos taurus
tttagccataaaaaatgacaatatattagcatacactataacttggctggcccttgaaacatattatgtaagaaatcaaacataaaaggccacacattgtrcaattccatttttatagtatgtccagattaggtaaattacatagagacagagaaagatgagtgttggccagggactgggggagggagaaaatggctgctg

SEQ ID NO: 111605 - DNA, 201 bp, Bos taurus
ggccacactgggtttccccctggcatgtattctttcccagtctacattgctcaggctccaggttgctctgcaggggaactatctaaggtgggccctgagtygtgtgcaattccaggtctaaaccactcaggttcaggttcttgggtactccacaaaggcacagactcagttgggcctgcgttttgtgcccttcccaggtct

SEQ ID NO: 111606 - DNA, 201 bp, Bos taurus
aagaaaaagaggaagagtattgaattttagagttcaaagccataaaacagaaaaagcactggtagcctctaagctgttttctccactgagttgcagcccayttctcaatcagcaagatgcctggagatccagaatgtaagactctcaaattctcggcagatcagctatttgggaaatatgagcatagcgactgcttaagga

SEQ ID NO: 111607 - DNA, 201 bp, Bos taurus
tttcaataggcagtatataaatgtgacttttgcttttttaatgtccacttttaagtttttgcaactatattaactttttaaattataattcaatattgtaygtgtatggctagaatgaaaagcaacagtcacctcccctgcacccactggcactaacaagttagaggaagaatttcaaaatggcaaccaccagcattggcc

SEQ ID NO: 111608 - DNA, 201 bp, Bos taurus
ttaactcttgatgatttccagtatgcccattcaagttcaaggtctttgcaggccagttgttactagccaaaaagtgcctagtattctggccaaaatgcccygtggttttgctgattgaccaaacgtgtcacagtgtacattttcagatagatagaatgttttccttagatctaattctaaaacatcatggccaccattgtc

SEQ ID NO: 111609 - DNA, 201 bp, Bos taurus
acagtaaaatacgagtctcagcagaccctaataaactgatcgttcaaataggttgcttgtcttttcacctagtgtgcatttgtttaggccacagagctcckcaataagagacttaaattgtattcagtgcttaaatgggagtaataaaaataagtgggtgggccagggattgaagccatgtatttaaatgaattttaaacc

SEQ ID NO: 111610 - DNA, 201 bp, Bos taurus
tccaatgaatcaaggagacagtatagggttaggggagatgtagcctccttcaactgactttcaagttatcagtctatgaaaaatgtctctcatttgtttaratgccttcatgtatctgccacatctgagtcattaagttctctctagtttcagaaaagataatcaatattctcagccagggatgtgcccaattgtttctca

SEQ ID NO: 111611 - DNA, 201 bp, Bos taurus
tgaatatcaacttttaattacctatctcttatcaatcttctccttcaatcctgctctccatgtcccctggctattggggtgcatcaggaattgccagagaratatgatactactgccctccctgacttttagcaccatttccacctcatcctcttttatttagctttaggagctatgacagaggtctgcagtagacctatt

SEQ ID NO: 111612 - DNA, 201 bp, Bos taurus
ttaacccctgctctctgcaactagagaaggcctgtgtgcagcaacgaagacccagtgcagccattaattaattaattaatcaattaaaaaactgccaaaaracacttccatttgtatgctgctggccacgcctgcttgcaagctggaaataaaatgtccattgcaaatggtcacaaatctgaccttctacaactctgggaa

SEQ ID NO: 111613 - DNA, 201 bp, Bos taurus
ttttcacttgaggaaagtggcccccaaaaaaattgctctgaaagctaattaagctgatgtccatgagacccaaatggccatagtaaagaaatagttcttaycttattttattttcagttcagttcagttcagttgctcagtcgtgtccaactctttgtgaccccatgaacctcagcacgccaggcctccttgtccatcacc

SEQ ID NO: 111614 - DNA, 201 bp, Bos taurus
gtctttccagcaaaaagagtcaccctggaaagctgtacacatccatatgggttgatattaaaggagaaccacagttactatatttacaaaacagtgtacaragtaagacgtaatttttggtaaattatagagctaagtataactgtcctgatatgccaaaatattctggaaagataaatacactatagtgctaacactact

SEQ ID NO: 111615 - DNA, 201 bp, Bos taurus
aatggaacaccctaaaactgcagacataacatgacaacaaataccccttgagtgtcacaccaagaagaaatttaaatgccaccaaagtctactatacttayagtaatcaaggataagcagtagatggaggtaggagtgggagaattgaacgaagatggtcaaaaggtacaaacctccagttataagataaacaagtactgg

SEQ ID NO: 111616 - DNA, 201 bp, Bos taurus
cctgtctttcccctcaggcctccagcagaagcccgtagccagctagctcagctgtcatgccagcaacttctcaggagctataaggcccagctgaagggagygcttgactctaagttagagatgctaaccatttctggtagtgaagaatgaagagccaggtgtcctggattcaactccctgctctgtcacttgttagacatt

SEQ ID NO: 111617 - DNA, 201 bp, Bos taurus
tcctttaataaattacatcttattccattgttctataatatttatgaaatgattagtgcaataacatcattgaagtatcatttaaaaggcaaataccctayagatttggatttgtcatcccgattccttggcattcaataatataagtgtctttagaggcatcttcttcatcttctgatttcttcacagtaaatttagcct

SEQ ID NO: 111618 - DNA, 201 bp, Bos taurus
aaccctggtgaccctagacctttgttccatcattaagcttttgaccgatacttggtgccttagtctgtgctggtgatggggggagaaaaaaggatttcagyggaatctaacccctgatataaattagtcctcctattccttgtgtatgtcatcgtccacagcacccgaaaatatgtaaaccatatcttcaccattaagaag

SEQ ID NO: 111619 - DNA, 201 bp, Bos taurus
agcatttaacctgcacaggagtgcttatttatagctgcttagtctttctttaatatttatgatttatgtacttggtggccctggtcttggcggcagcatgygggatttctagctgcagcacgcacacttagctgtggcatacaggatctagctccctccccagaggtccgatctgggccctctgcttgtaagcgcaggggc

SEQ ID NO: 111620 - DNA, 201 bp, Bos taurus
ctcgaggccgcagggcctccagcggcggccggagggcagggcggcaggtgcgggagaggcgggagccttccccatccgggaggatgtgccccggaggtcgyaggccggggcgagagaggaaagactcgggagcccgagatactggccccccgggagcggtggggcagtcaggggcgactgtagacggccgcgtcgggagca

SEQ ID NO: 111621 - DNA, 201 bp, Bos taurus
aggccacggtaagtattttggcttcttctctgactcaaatgagtcagtgaacagcttagagcagagtgacaggacctaacttgtgtattaaaaataccatyctgaagatatctgcttctggccataatggagtaattggtactagacttgccctctgctgataaactaaatatgaaacagctgttctcaaaaataggtaga

SEQ ID NO: 111622 - DNA, 201 bp, Bos taurus
attagttcttagaataatacaaagcagacttcttcagggagccttccttgattttcctggccatctccaactccccattatggaggcccttattagcctcygtatatctctttattaatgcataatatagcagcaattttacatttacttgtgtgattagtgaggccattgagtagagtatttaaaagcaaggatttaaaa

SEQ ID NO: 111623 - DNA, 201 bp, Bos taurus; identical to SEQ ID NO: 70556

SEQ ID NO: 111624 - DNA, 201 bp, Bos taurus
ggggcccagagcttcatttgaatgtttttaaacttttgctgttaccaccttgaaattctgaatactttttgaacaagggtccccacatgttcattttgtaytgggcctcacatattatgtagcagatcctgctttgaggtcattaactgtcatatgaactgttagaaaataccgggtattgggaaaaaggtgaatgagatg

SEQ ID NO: 111625 - DNA, 201 bp, Bos taurus
atgaattccagcctgataagaaactcaggcctccttttaactgttttcctctcctacatccaaaacaaacatactgcaaatcctcagtgccagctggcacyctggccacatcacattgtagatcatatttctacctctatcatccgcacctcagtttatttaaaacacaaaatatcataaagtaaacacccaaagcagcct

SEQ ID NO: 111626 - DNA, 201 bp, Bos taurus
tgagagatcaaataggtctgtgcataaaagcacacagtaaactagagaaatgtatattaaactagttaggcaaatattaggcattccttatgaacaagtgygtatagaattagtgtagaacacttagttcaaaaggtcttctgatccataacaatatttcatttgcctttggtcccaccaaaggctttactgcaattatat

SEQ ID NO: 111627 - DNA, 201 bp, Bos taurus
caccttggaagccccatcaaacaaggtcagattgagtcaacggatatccagggtgcagttccacaagggaaggacagaagtgagacaggccagggcaggarcagcaaagcccagagagctgaagtgcttagaggaggggcttgtctgagttgtcgttcatgacacagcagccaggggagagaggagatcctgatccttctt

SEQ ID NO: 111628 - DNA, 201 bp, Bos taurus
aaacagaaacagaaatgcctttataaagcttataagcaagtcagggactcaggtggaagtatagttcggagtccttaccattaacatttcactataaagcrcatactcatgtacaacaggaagcagggcctctgagaatccagacatccgtttttcagtggccttacagcatttgtcaatgcagctggcaacacttttcag

SEQ ID NO: 111629 - DNA, 201 bp, Bos taurus
caggcaagagtaagggagtggggtgccattgccttctctgaaggaaatatcagatagtgacaactcacacaaaggaaaccacttgaatatgagacccagcrtcacttgaccaccagtataggatgcctcatctaaacaacaaacaaaacaaaaatacaaacccaatcatcagcagacaggattaccacctcactcagcctt

SEQ ID NO: 111630 - DNA, 201 bp, Bos taurus
ctttaaaactaatgtaatctttgcatcgatgacataacatttttgaggtaaatgttcaaaggtgctcataagttctgtttcagtatgttagaatgctgttrttgatggagagccaaagataaggcaacaccaagaaaaatatgaaaagaaaggtttaagatgggaatattttggaacatttgttgacagagcacagaatat

SEQ ID NO: 111631 - DNA, 201 bp, Bos taurus
atctgtatttttagtctgtaaagtctctattggatgttactgttacttaagcaacaatccttgttctctctcaatctctctctttttttctctctctcaayatgaattaaatgccaaaattttcaaataaggaagaactgatttaacttccacttaagagagggtaaagcatctgcctacaatgcgggagacccgggtttg

SEQ ID NO: 111632 - DNA, 201 bp, Bos taurus
atgttttccttttatttcttccctgatgccctgaatgtattaccaggcattttaatgagatgtggctaggtccagccctggccaataattaactccttccsctctgtcagactgttagcattttatggcatttctagcctctgggagcttaagtgtagggcctaagtaagaaagtatctctggcaccgtttccaggataag

SEQ ID NO: 111633 - DNA, 201 bp, Bos taurus
tcactcattttgacaagtgtgccaaaactaccagttttttagaaaccacttatcgtcccagttcacacctgtgtagcttcataaaatggcaaatatcctgmagggaaaacttgccatgtaatgtgcaagttttctaccccttgtttctcagtaggctccttgccccataagtcccaaattccatcttttaaccagcttgct

SEQ ID NO: 111634 - DNA, 201 bp, Bos taurus
agaaactcataaaaaacatctgagagctgaaacagcggttacaaatgtgtctcactctgaccatgttttagcctctaaggaaaaatagatacattctcatytgtaggagagtaatgtagtaatttgaaaaatcaaatccatgacacttcattatgggatcatgtaggattttattttcaagatgcctcattgcaaaattaa

SEQ ID NO: 111635 - DNA, 201 bp, Bos taurus
atgtggctttatgcatccctgtgattctccatcttgctcgcctgtattgtttttaaatcttgacccaaaaatagttcaaataatgtattctttaatgcctytttttccccctcttaaaaatatagggactttccctatatttccttcatcacttcagagttacagttactggcacataggtctcaaagaaatactgattgt

SEQ ID NO: 111636 - DNA, 201 bp, Bos taurus
agatgctgaattataattttctttataaattatcagcttagttgagagaagctcaccattagaactcttctcatttaaatcatgcttatttgaatatattyatgtacaggttgacaaagaatctccttttgcattatattgctttttctgaagccagagtttctcactgtttggccttcgttggtctatgcaggagatcag

SEQ ID NO: 111637 - DNA, 201 bp, Bos taurus
aaataaatggattggcctcagctgactcaattggaaaatgagacgcctcaattccagttttgactttctaatgacttagcatgctacctttgcaaatgatrtaagctctttgggccttggtttcctaatctctgaaatgaaggaactggactctatcgaaatcctttccagcttaaagaatggtgatcctggatatattct

SEQ ID NO: 111638 - DNA, 201 bp, Bos taurus
gtccatttcagaatccaacagaaattgcatcactaataaggcaaatgaggtttttaaacagttgcttctcatctccgcacaagagggcagcctttcaccaraaccaaggaaacagttgggcagaactttgtgttaatttgtatagagacccctccaatcatagaacttccaaagagaagacctctcttgctataaagaatg

SEQ ID NO: 111639 - DNA, 201 bp, Bos taurus
ggagagctttatgcctgctgctaaatgtctacaaatcaatatttaatattttgaaacatgaagtcttaattatccatctcccctttaagcgtgaaaccctyactgagtgaaaataaaaccatttgttggctgatggattgattgccacttattagcacttttttgatctgcaggtcagattgcagggctccattccaaaca

SEQ ID NO: 111640 - DNA, 201 bp, Bos taurus
tgtaggaactgtacacattactctgtccttaggacctaaatctgacaggaagaatttcccatcaactagtaaaaaggaagagttcctggagacatactccycatgtaaataaacaaacatgaaatatagagagctttctctctacttaaggaagagcaaaaagcaacacctgagaacaaggaggagcatgtagaaaactca

SEQ ID NO: 111641 - DNA, 201 bp, Bos taurus
aattgactccaagactgtcaaggcttttcatttgttgtcttgactcaagccaactgacagtaaaagctctccagccaaacaagacaactggcttcactctkcagatgatgaactctgtctgccatactcctgtgtgagcactgttaggctatgtaacttccaggtgttctggccagtccttttgatcaggcagggctagga

SEQ ID NO: 111642 - DNA, 201 bp, Bos taurus
tgttagatccccccaccccctcaggtaagaatgtatatgaatactgttggaagaaaaacctaaattcataagtataattaaagttgtgtcacattgctttkacctatctcatcttctctcccaaaatagaagaggaaaagctctaatgaaaaaatactgttgagttcttaataaaacatttacactttaaagtcatgctat

SEQ ID NO: 111643 - DNA, 201 bp, Bos taurus
gtgaaatggcatgattagaggtttccttccaactcaaagagtctatgatcaggttattttacttgagaatatacatttttcaattcctttttatgtgaggygaaatatccagttcaaacaaaaataagtttccgttctagaagttaccattcatgttgttgttggtgagccaaagttatttaactaatgcaagtttaaata

SEQ ID NO: 111644 - DNA, 201 bp, Bos taurus
tgattacattagagtccacactctaagatccaccacagaaaataggtgtgtaataaggagttcacccaaatctccagccatatcaagttagttgcagtttmctacgggtcccatttcttcagatctacatggctttgcttatcctgctttctctttccataaagctctttccttttaatgttcttaaaattccttgttttt

SEQ ID NO: 111645 - DNA, 201 bp, Bos taurus
aagtaagctacacagagaaccaaaaacaggtcattggcttctgccctgcaattcacagtaactgccagcaatatttctacataggggaacgcgctttgcaygacagctctccttgcaggaaatctccatcctggggagttgaaattgcattaggattacttctctgcaagcacactgacaccaatatgcaatatgtggtat

SEQ ID NO: 111646 - DNA, 201 bp, Bos taurus
aagttaatgagagttatatattgctttgtagttaagagatgccattttgcttttcttatgtcgctgaatacaaatttctaattttaatgagccttcaggtygatggaattaaccttacatttccattgtcaaaaatcatattcagactgtaaggtccaacttaggtgacctttctaaagagaatttccccaaaatcttatg

SEQ ID NO: 111647 - DNA, 201 bp, Bos taurus
ttccatcaggtgtgagtacccgaagacaggactgctctcagcctgaacaatttaaactgagtctggttgattaaaagaaaaggctcaagcccaaatggcaytggaggcagcagatgataaaccagcctgtaacttttgggtggtgttaaaatggtcatacatttagtattatttaaatattttgttatcaagctcagccct

SEQ ID NO: 111648 - DNA, 201 bp, Bos taurus
taaagacagactagaagagatgtttagaaatgaatcaagaagtggaggaaagtgtgggaaggttaatgtcattgttgtaaaagtttagaatgaagagttaytgctatgggttaagaaaaggaggttaaaaatatggtttgaaattacaaggatgaccagtagaggaactgagaataaaattttaaatgttttgcaagattg

SEQ ID NO: 111649 - DNA, 201 bp, Bos taurus
caattgtattatcatcttactttgtcttgagtttcaacatgaaagaagagaatcataactaaggtagagagagggcatgtgaacaaatgataaatgcaccrgattatttcagatgacctgaaatatctcagagtttgaatgttaatcctgacaatgaacagaaaacagattccaataacaagggattttccgctgctttat

SEQ ID NO: 111650 - DNA, 201 bp, Bos taurus
ttagaggtaagcactgtacaatggattaaaaagtaatgaattctaattcagaatttacctccaataaggtgtgaatgcgggaaggtcctaccagctcatgraagtttagtttcttcttccataattcaaggaaatggaggagaacagaaaatttctaaattctagaaaatccatgatttttatgtcactcatcaattactt

SEQ ID NO: 111651 - DNA, 201 bp, Bos taurus
tctaagtgatatcaaggtgtttgtttttaatctgtccaaaatcttcctatggacaaatgcattattgaagaattatattttaatttatcttcacgccgtgyttttgatgggcatttgcattaacacaatatgattatgcttctttacactggtatctattcaaattagaaattacctgcacatacagtctcaggtggtggt

SEQ ID NO: 111652 - DNA, 201 bp, Bos taurus
agcagactcacctttacttgtagtatatccagtcatgtacttgtctaagtcatactgctagattatcagtgctttatggagaggaaatgtattttaatcayatttgtatcccctgcagcactttgcaaaatgtttagtatcaaaagagaattcaagaatgtttatgaaattggatcataaaaattgttaaacctggacagg

SEQ ID NO: 111653 - DNA, 201 bp, Bos taurus
atgttgttaagttttaaaaaaacagaagagaatatataatgtaaacatatagctgcatacttgcatatgaagaaaagatatatgaaagtggcttttaacayagaacaaaattattttattcccctatatccacttggctaaatcttatctggcttaaattgacaattctccaagaaatcttcctgggcctccattcaaaga

SEQ ID NO: 111654 - DNA, 201 bp, Bos taurus
gagggagtggatctaggcaaacaaaagcgtggccaaaatgacttctactgtcaatttccatggagcatccagagaggcttttgctcactgtcagaattgayaaccagaaagttatggcctagggtgagatgaaagtgaagtgaaagtgttagtcactcagtcaagtccaactctgtgaccccatggactatagcccaccag

SEQ ID NO: 111655 - DNA, 201 bp, Bos taurus
gcaatgagcaattggtacagaactcagtagcctgtaagaaaccataaaggaatgctttacagaccttctgtttgccttaaatcctgaaaatacatctacaytagagttattgagttttttgaagacatttgggacttcttaggaccaatcctgtttttctgtctttaggagacattgtgctcccttcgtcattgtgcttct

SEQ ID NO: 111656 - DNA, 201 bp, Bos taurus
ttcattgctgtattaataataataaaggcatgctaaaggaatgaaaaagcatcattataaaggggatttgtgtgtgcattgaaacagtatgggtaccttgyggttcccacaatgaagatgtaactattttcatatacaagttattagcttaagttgttctttattacaccataactttgctcctatagtaacatggtcgaa

SEQ ID NO: 111657 - DNA, 201 bp, Bos taurus
caggaccaaagttctgcatacaaaggtcctcacaaagaagaatgcacattctctttccaaagaattcttttctaagggaaagtcttctttctatcctcagygccccatactaggttagttcactggttctcacattcaaagagcaaaaaatctctacagcctcattcaaggtgtggtcacagacagttgctcactgccacc

SEQ ID NO: 111658 - DNA, 201 bp, Bos taurus
ccctcttaaggccaccagtcaaaaaatgggactgcagggtagcatgaaatcctgtctccaaaactaatggcagaaacctctttagaagacgggttacattrgaggccacgtgtgaataaaatgttcccgaggatagataagcttggcaagcaatttggcagctgtctcctggacaagtgtccttcactggaggtaacaatc

SEQ ID NO: 111659 - DNA, 201 bp, Bos taurus
aaatgagggaggaaaatactggaaggtaataattcaaataaatgtataggatgtaaataatggtaatcgccaagctataatctacatggaggaactcaggraaaaaaggattactcagcagtgaacttgtatactggcctcatgttctatatgctatttgttctatctctaattttctgcgatctataatgttgataattg

SEQ ID NO: 111660 - DNA, 201 bp, Bos taurus
atagattgtgctttgttttacttgttatctctaccccaattcccaccagttttcttcacccttgagtatatttatatatatcaacatcaaacaagtagatyactacccatgtctttacctgtgaatcacattcagaggaataaagaaagcacaaaaggacaaaggaaacagtggattactcctaatgaagtcccacagttt

SEQ ID NO: 111661 - DNA, 201 bp, Bos taurus
tgctagtctgctctacccagggctaaactctaaccctgattctaattaccattattacagaatgatgaaatctgaatttgaaatttgaaaaggggccttcrattcacccagtttaactcctcactttacagataaaaaaacaaacaccagcaaggtgaatgcacttggctgagatggttccgtttggtggcccttatacat

SEQ ID NO: 111662 - DNA, 201 bp, Bos taurus
ccttttcccatttctcagtcaggaatccagagctcccttaccatctctctggtcacctggttggggggaaggggggggccttccagccccctcccaaatcrtcccttcctcctcccctactcctagctgaagaagctctgaatcaatctagtcctgaattagatttctgatggctccctgcccgaggcctctgtttatctt

SEQ ID NO: 111663 - DNA, 201 bp, Bos taurus
cctaagctccccatcctccttaaatccctgatccccgcctcttgccctctccagtccttcgccttagtgttatgagcatccgttaggccttcagcatcatyctcctggtatatttgtttctcccaaatgctttcccttctctggttgagacccctcagcagggcccctctatccactctcttcatacgctcctttttagca

SEQ ID NO: 111664 - DNA, 201 bp, Bos taurus
ttcagcgtcttggtgtaaaggctagatattgaggctgtcccaaccctgagtatggaagaggaataaggaagaaagagggaatttctctggcaagctagaarattctctctgactcatcatatacactggaggacatgacatgagtaccttcaaatccaagtcagtgaaaaatgcttcaagtaggactcagactggccttat

SEQ ID NO: 111665 - DNA, 201 bp, Bos taurus
gcaatttccatgggcccaaatccttctcctgaggcctgtgcctttgccaaaatgggcaaaggatcctgtggctggagggataattggagatgcgtgggccrggcagatgtccacatctgacaagaccagcactttaaatagcctggagagaatttcagtcaggcaggaagacttctgtaccgacatcccactgttccctgg

SEQ ID NO: 111666 - DNA, 201 bp, Bos taurus
ggcagactccttccccagcccttccttcctgccagagtttgggctgacctcccccaatgctaatgaacagctcagaaatactaacaagtgccttggcaccyggaatccaggcagcatcacttccaatgtgaagctgggccaagtcccggccccagtgcagtctcaggggtttcctaggccccgtggagcctggtggcgtgg

SEQ ID NO: 111667 - DNA, 201 bp, Bos taurus
acaacacatacattgctcctcactggaaggagcacgtgccacttttccacgaccacttttgattttaagacttggctaattcacaaggcctcaaaatccartctgctttgctcttggattaactgtgctatttgaactaaaggcttaacttgttcttaatcatcttttggaaatgctgacttagagaattagtgcctggcc

SEQ ID NO: 111668 - DNA, 201 bp, Bos taurus
ccctggctggccattaaaacccactcacatcagatatttagaaactagaaaggtagaagtagcaaggcacgtttttaagcagcactagactagaatctcaygttaccatagaagttggcctttttgatacacatgaaaagatagttgttttgggtaagactgctttgttatctgaagttttctgtttttccaaccagcttc

SEQ ID NO: 111669 - DNA, 201 bp, Bos taurus
attgaaagcatacaaagaactcatacaactcaacatcaaagaaaaaacaaataacctgatttaaaaataggcagaggacctgaatagacatttttccaaaraaggtggccaacataaaaagatgccaacatcactaatcgtcagagaaatgcaaatcaaaacagtgagatatcacctcataccggtcagaatagctatcat

SEQ ID NO: 111670 - DNA, 201 bp, Bos taurus
tccctgatttgcactggcctttaatttctaggcatctggataaaatgtttattgttgactcattgcctaggttataaagtgatccttgtctcttgctgagwaatggatctagtagaatagcccaggccttaaaatcaggcagatctgagtttggattccgtactgccaaattaccagctgtgtgaatttggttaacaaaga

SEQ ID NO: 111671 - DNA, 201 bp, Bos taurus
gggtatgaagtgatagttcgttgtgattttgatttgcatttctctgatgtttagtgatagtaccttttcaggtacctgttggccatttgtttcctgctggyaccctgattctttccttttgtctcactcagttcagttcagttcagtccagtcgctcagtcttgtccgactctttgcaatgccatgaattgcagcattagg

SEQ ID NO: 111672 - DNA, 201 bp, Bos taurus
agtcatagcttgttgactagatgaaaccttctaatctagaaggattagaaatccttctagaagcaggagagaagcccttgaagctaaacaaggccgtctcrggacgaatctggtaagtccagcaccattttattagatggtcagttaatatttgaaagtcaaaaaacttaaatgattcagtagtatttaggtgtttttctg

SEQ ID NO: 111673 - DNA, 201 bp, Bos taurus
gttcgtatttctttataagcatatagaaattgaaaatggcccaaatctgggactgcagattcctgctcatttatgacactgtgctttactaaattaatgtrtaaacaggggcaaaattctcttgtaaagctcaggaggcatttgcacagtgatatatacaccagtacatgtatattatatgtcatttggcactttggttct

SEQ ID NO: 111674 - DNA, 201 bp, Bos taurus
agtaaatggccgcagttcaaccacgatgaggaaattcagctttctctgtggggacggctcccattagccagatacagaaaagttggatgaccaatgatacyaactcatgcacgcctaaggcccaaggtggggggtggagggtgagatctgaagaagggctgtccccatttaccaggagcaccactgccccagctttctccc

SEQ ID NO: 111675 - DNA, 201 bp, Bos taurus
gaccgttgaaattggaatttttctcttttaaagtctgctttgcatttcacctgctgcagcttcaccactgcacatggatattgtctctccctcctctaaasttctcagtcatggtccaattgtaccttgacctaaattgaagagcaaagactatcttgttttcccttatatcttccagagtttttaatttcagaggctcag

SEQ ID NO: 111676 - DNA, 201 bp, Bos taurus
ggtaacaatggtagacagcacacagtgggagctggaggccagcatgaaagaaatataatctgaccaaggtcactgtgcctatgggctgggatatgtgaatrttagcttagcaggaggccatggaaattttcacagaccaaattggcatttggagctgagatggaaagctgtgaacacaggatgttactgcaaacagggctg

SEQ ID NO: 111677 - DNA, 201 bp, Bos taurus
attgatttccttattgaaaggggaaatttggacccagacacagacacacataaaggcaagatgatgcaaagaaacacaaggagaaggtccaagtccaggakggaggcctggaacagacagtccaggagagaggcctggaacagacagaggctttcctcacagccctcagaaggacccatcttgattttgaacctgtagcct

SEQ ID NO: 111678 - DNA, 201 bp, Bos taurus
ggatcctatatgttgtgtggtgctggccaagaaaattaaaaacacagggcacttgttgacacttgtgagttttagaagtctcctctaagagcagcagctayccaggggccagttctcattttgcagttttgtcctgaatttaccacaggcactagaattttaggtccctataacatattatatactcgaacatactaagta

SEQ ID NO: 111679 - DNA, 201 bp, Bos taurus
tccttgaggcttgattaaaaaattaaatggctaaactttgcctcaatattttgcattgggattttgagtgacttgatgattcttttcagggtgcactttcyttttcttctcttggcttgaaattaagaggtaggagaaaaggaggatgctcccgctgtgcagttgttcttgagttgggctttaaatgaagcatgtagaatt

SEQ ID NO: 111680 - DNA, 201 bp, Bos taurus
tctttctaaaagctcctattccagcagaagaaacagatgagttaaatacgtactgtccataatacataatcaaaacttgtcaagaaatgcatatgtgtaaytagaatttgaaaataagctgaaagagagagtgaaaaaactacttttaaaaatgacgaaatcattttttcttaagtttgatgaaaatcatcaacccacaga

SEQ ID NO: 111681 - DNA, 201 bp, Bos taurus
atcttcctgacatggggatcaagcccatatcttttgcatctcctgcataggcaggtggattctttactactgcaccacctgagatttaagagaaaatgacyactcatcagctatgccttgatgaaacattatttctaaatttgtagcattatagaaggtgtagaggagacaaataagatatattatgtgaccccataagag

SEQ ID NO: 111682 - DNA, 201 bp, Bos taurus
gaatctgattcctgatggagtgtgacaagtcagtgtgaactctgggcagaggcaaaggagcaccagttaaacacttggccaggtgatgtaaaaggtcaggmaggaagaagcacaagagaggcagactccctgagataatgaatctgccagagcctcaggccttccttctccttgtccttatgggggttcgctgtccttccc

SEQ ID NO: 111683 - DNA, 201 bp, Bos taurus
ggcgacctagaagattagtggcaacacgtgtgagctacaaaatgaccactgctttgcttctccccttcaaatctcctgcaagaatatctgctatggccackctaatgggacacgtgcaggggagggaactctgggaaaggcagttcatcctcaccaagttgacactatcaagccaccctgccaggtcagctgcttccatgg

SEQ ID NO: 111684 - DNA, 201 bp, Bos taurus
ttgctgcatatgataaatcagcagtcatcattccagtatgctaatgtgtcactcaggtatattctttagatagtggcctgttcttttaaaagatgatgctktaacttggttatggcaagttggacatggacaggtagactggagtcatgaagcgacaggtgggccaacaggaagatgattaactttatcccttactttccc

SEQ ID NO: 111685 - DNA, 201 bp, Bos taurus
tctctgggaagattctcttactagatatttctttactttgcttttagtggtattactgtaaatcatgtcctatatattgaatctcaggatgctgcaaatgwgaggaaccataatatgaaaaatcttaggatgctacaactgtgagcaaccataatacaaaccaacatttcatacagaagactcagggggcttagaaagttg

SEQ ID NO: 111686 - DNA, 201 bp, Bos taurus
ccgaggtaggtataacggaagagtttataaaggctgaagcacaaaggctgatggaaagtctaatgcagcatcagcaaatgatggagtcgaggaagatattycatcaggaacaagtgagactaatggagacaaacagagtataccaggaggcactgcaacagagggccatggaacgtcagctccaggtactcatcaattatt

SEQ ID NO: 111687 - DNA, 201 bp, Bos taurus
gtgtcataacaaaagaatttcaaacagaatggggaataaagaaaagtttcttttacttatactgtttattatttctcagtagtatgtccacctcagtgtaytgctgctgtgtacacacaattttatttaaaaatatgtttaaaataagaataaaaaaaaaaaaagactggaaggggagagattaaaatattatgtctgagc

SEQ ID NO: 111688 - DNA, 201 bp, Bos taurus
aaatatgggtactactaaagaagcaaggattatcagttctgtggagcaagaattctcttagctattctagccggataatgcactggctgatgtggcttcamccaaacgtcgtctcttttagatgtaggaagcccactctaaccattcaaactttcaactttaggaggaaaccaagtggaacagtgagagaacaactcccag

SEQ ID NO: 111689 - DNA, 201 bp, Bos taurus
tttattaattgtggctctactttttaatgtttccttttttcatctttgtctggctttattcttgtgttttttctaactttttgagtttaataataattcartaacattcagtctttcttcttttataagaattcaagactgcaatttttcctctatatatcactttagcttcactcctggctggatgaatcacaagctgga

SEQ ID NO: 111690 - DNA, 201 bp, Bos taurus
aaacaataaatctaccctcctctcctgccctgcaaaccatcactccaaacagaaaatgtggaaaaccttgcaagaaagttggattctgttatatttccacrccttcaaagttcagataatttgggaattcttcaaaatttggatgtagtttcaaaccaaatctaaacattttttttgtttttccacaacaaataaaattca

SEQ ID NO: 111691 - DNA, 201 bp, Bos taurus
aaacacagatagtacatagaagtgattgcaaagttgaataaacaccagattagttttaaaaagtctgcaacttcctggtggagcctttcaaactgaactgmgctattgtctgacaaagtcgatggtggccaaaatgttgcattaccttccactagtgttcacgtgagagggtatctgacactggcgtgaagaagaggtagt

SEQ ID NO: 111692 - DNA, 201 bp, Bos taurus
gcatagctggggcaaaggcaaaggatgttgagcatctgtacagacacagtgttttgcaaacccaaatattgcccactctcttcatatactaatcacatccyatctgtcaccaagtgctgggtcctctgtccctgagatccatctgcttctccccaatgttatcaccacttccttggacaactgcagtaacctcctcagagg

SEQ ID NO: 111693 - DNA, 201 bp, Bos taurus
ttggccacctggctagtctccagatagcagtggggccactaaataggcaccctgattgggtaggtatgctggctcggttccatgtcagatggggccattarctggcttctgaagttacctctggtagggtatgatctcaggctattttccctggaaggacagtagcacttgttggattctgcaattaggcaaggcctcatg

SEQ ID NO: 111694 - DNA, 201 bp, Bos taurus
ataacctcttgaaagactctatttctaaatatagtcacattatgaggtactgtggttaggacttcaacatacgaatttttgagaggatacaattcaggccrtaagactaagtgtagctctttcttcaaattcctcatggatgtagcagagggaggaaaacccatttctttactcttcaagcataaactctggatcccaagt

SEQ ID NO: 111695 - DNA, 201 bp, Bos taurus
cacagttcctgacttacagctccccaaaccctttgaattttctaagtgttgagactgacaaagctgtctcatgataatgaagtggctctcgggcctcactraggttgggggcagtttacctggagaaccaaccttgtgattgaagacttccagagaggggaaagggcctggaggttgaatcaatcaacaagggccaatgat

SEQ ID NO: 111696 - DNA, 201 bp, Bos taurus
tatggcttaacccctatttcttttaggtaatctttgttatgctagagcgttgatcaaatggaatcgaactcacttggcctgtctgttgaattaagctgaaragaactgctcgcatctctgctctcagaataatacgaagtggcagctgtgtagaactgatagagaatctagtgcccctgcctaaaaaatagaaggcctcat

SEQ ID NO: 111697 - DNA, 201 bp, Bos taurus
caaaatagggcgtgtatgagctaaaaagtaacttgggccagagtataacagcatgagggaactcctctcaaagcaggcaacatttgagctgagcctaaatyataagaaggaaggggccagctgtgtgaagttctagagagaagtttaggcaaactgtgtggatcacaataaactggaaaattctgaaagagatgggaatac

SEQ ID NO: 111698 - DNA, 201 bp, Bos taurus
gcataatctacagtaggcactttttctttctgtctacctttcactagcagtgaagataagtgaagcacctagggctgcgtaactggtaaagacataggccygggaatagaagttggggcttttgatgctgtctgaaataaaaagttctgaaaagccagcattgataccagtggaatcatagtggtggccaggttaaatacg

SEQ ID NO: 111699 - DNA, 201 bp, Bos taurus
ttgtcatataaataagggtttttgaaatagctttcatgtcttctctcatttgccttcaggccctttgcttgcactggattactatggtaaatgtatcattyataagtccctttgagtaagcatgcttatctactgctagttatgctaccaaataatttcacttattagtatataagcatgataaaaaataaatggttctaa

SEQ ID NO: 111700 - DNA, 201 bp, Bos taurus
tctgctgaccctagtgggcaataaaaccccatcggccgtcctagagcttcgagctagtctgatattccatgaaccaccctgacattagtgccttctcatgycaggttttgagcttcctcttgttttctagcactgtgctctttcccttatttatttatttattttttttgaaactgtctgtagctttacacttctgagctt

SEQ ID NO: 111701 - DNA, 201 bp, Bos taurus
tagagcatgcagcacagagaaaatgaaaagagctttcttttgttttaaaaagaaaagcctctagaagcaaagcttaactgttcagtgcaagagatcactartaaacatcagattaatgccaaagatgtgtataactagatttgatttctttcaagctattctagcctccttcatataccgctagaacaactcaaaatggca

SEQ ID NO: 111702 - DNA, 201 bp, Bos taurus
gctgttacttaaaagtctatttaaatgttacttcctctattctagctcctaaaatgtattaacacccacattattgtactcacacattgtacaataattawatgcttatacttctctttttgagcttcttccataattttctacttctagaatctaacacaatagtaaccacataaaaaacatttaagaaatggttttgaa

SEQ ID NO: 111703 - DNA, 201 bp, Bos taurus
agctctagatgacatacaagctcctgggcctcaggacgccaatgcggcttggtagtctggggcagagagatgaacaaccgtttccccaaatttgtattgtrtgctgtcacctgggccttcagaacaaccccaagtcttatcaagctgcgctcatggaaaaaagtagcttcaccccaacagtcctctccctaacctcatttg

SEQ ID NO: 111704 - DNA, 201 bp, Bos taurus
agcctctggaagaatggataaatggtggcaaagatgttcaaacaaaatgcagtggtagtttgacaatgatcattctaggcttgatctcagaaaatatttamattaactatttccattttaaaataaaatatttaagttcacaagtagcagcaaaaaaaaaaaaaaaatcccagaaatgcatataaaaactgaacaggatgt

SEQ ID NO: 111705 - DNA, 201 bp, Bos taurus
aacttctgcacagactctatcgactgagtatgattctctttcttggtcaggagagaacaagatagtgcctcttccatacaggagcttttgaaatattcgaraaaaaagcaatcatagattcttcaagtccctccctcattagggtaacatttcatgtttcttcagctgttacttacaggaaatggctttcaattcccccca

SEQ ID NO: 111706 - DNA, 201 bp, Bos taurus
caattcaaaacccttcaaaacatggacagagtaatggtaactaatgcagtggtagaggattttcctgaattgtccacatttatttcatcagaaagatagtrtaatatataaagttcaaatgagtttaggatcttttagtcctgacttccgtgtggtaccttaatttacccttttatatccctatgagtatatccctttgct

SEQ ID NO: 111707 - DNA, 201 bp, Bos taurus
tttgacattgttctgtgtgtagaaaaacagaaagagcctcatttcccagtatgcctttaggaatccttaacatgaagggtaggaaacacccattctgcctycttctttattgctggtagtcagtgagatcactaggtaagggacaagtagtcaagctttaaatgatgcaataagtaattgcatgtagactgtgataacact

SEQ ID NO: 111708 - DNA, 201 bp, Bos taurus
aagatgtagatgctcttatactactttttctgtgccagcctttttgaacaacataaaagagtgtagagcgggcagcatgaggtctgacagtctctgaatgyggaatgtgggaagtgaaacagaggggcaagtgctgaaggaagctcttggaactgagaaggatatccaatggtactctcttgttatgacttttctggtgac

SEQ ID NO: 111709 - DNA, 201 bp, Bos taurus
ttagagttaaaacaactcaatgttgtgggaaatgaagtagactcagatttctggtgtgtcagtgcttagaaaagagctatttcttgagctaggacacattrattcctccatttagttaaaattcaccgtgtacccggcactagtctgagtgttagggacagagcaataagaacaaggtctttagctcatgaatcttcagca

SEQ ID NO: 111710 - DNA, 201 bp, Bos taurus
tattatccacattatatatgttatctgctggcccacatggctgtccagcaagtccatagtgaggtcatatgggtccatgtgcaagctgctgaagggtgatmttccggccccgcttctcagccactgtcctgttgggctccgtctggtacatgtgtttgatgaagcacagcaggcacttctggtttatgcaggcagctgcat

SEQ ID NO: 111711 - DNA, 201 bp, Bos taurus
aaaattcatattcaaacatttgaatggaaggattctaaacagtatcctctctctttctcttaattctattcccttccatgtatcttcattttcaataataytctcttcaagtggtagcaaaaaacgaccaatggcaaactaaagtcacatttttccttttgctcatgatctcagaaaaaaatgttttctttctgattagcg

SEQ ID NO: 111712 - DNA, 201 bp, Bos taurus
gataatacaataatcctacgcctatttaaaataatctgtcaataattaataaccttccaaaagagaaagcaccaggcccagaaattttcatgggtgaactytactacacatttaagggatcagttcagttcagtcactcagtcgtgtctgactctttgcgaccccatgaattgcagtacgccaggcctccctgttcatcac

SEQ ID NO: 111713 - DNA, 201 bp, Bos taurus
agcacctaatattgctagtgcctagaacagtgtttattgaatatttgttgaaagaaaaacttaaagaatatgttcacaggaagaacagaatttcatgaaayattatttatagctctaaggtaattttccatattccaagtctttccatgtatagaaggtcaaatgacatttttcattgctgttttttactggaattatacc

SEQ ID NO: 111714 - DNA, 201 bp, Bos taurus
gagagcgtttatccattgacaattcccactgagagctgttcagcctgactcaggaggcaccgcataaaggttttaacatgccctggcctgccactgtccawttgcaaggacagagacagagcctctgtgtggcatttctcagtccatttgtgagggcgcattcatttgacagaggaagggcctggatctaaactgggagta

SEQ ID NO: 111715 - DNA, 201 bp, Bos taurus
caacaagtcatcagagaccacagaaccacataattctactctgccacagcagtctttatttcaaaaggagtggtttccagcacaaggaaacatgcttcctyagatgctacacttcaacagtgtgctgagacaggtaactctaagaaaaaagtagtgaaattaaaatgagaccatgtctttcatataattttcttctcctat

SEQ ID NO: 111716 - DNA, 201 bp, Bos taurus
agaaaacactgtcagatcagaatctcttttctgaattttgataatgctaattgctcactttctatcctagttattttatcagtaaaattgttggaactctygacattgcattttatttgatagaaacgtcagtggaactccctgaacaatgtagactttgctatttcctttaatgaaacagtctcaatgctaaaaatatgg

SEQ ID NO: 111717 - DNA, 201 bp, Bos taurus
caatagaaaaaccaggtttctccccacagcatattgttgatatttttaacatttagcaagatacatactttctaatatctctaccatgattaagctgattyattctgcactaaacaattttatcttaacacctatccctgttatccagcatacaatgccttagagtttagcatacctgattttaaattctgactttgctat

SEQ ID NO: 111718 - DNA, 201 bp, Bos taurus
ggaggttaagcagtttgtttaaggtcacttgtccataatgctcttaaatgttatgatcttacttttctagacaaaagattttaatagactctgagaaagtrtgacaccccacaagcaatatgtccttattttggagcatttaactgacactgtgctctgtgtaaatctctaaaagaagaaaaaatgtgggaatataaggta

SEQ ID NO: 111719 - DNA, 201 bp, Bos taurus
atttttaaaagatatttttaatattaaagaaatatatggcttatgattatggatatctgacattctggaatgattgagaagttctcccatgaccatagttkaagaagactgctttttatattaatcataaatatcaatattttatttcaattttttgtatttattgattttaatgaaagattttaatggaaaattttagac

SEQ ID NO: 111720 - DNA, 201 bp, Bos taurus
caggaaagttcctaataacctatttttaataacctaaaaacagatttcccaatatagggcctatatagatctgtctcatttttaagggttgcataacatgmcactgtatgagtatactctaatttttctactcaatttccaactgataggcatcttgaaagtttttaattgttttctgtgataaaaaagctacactctata

SEQ ID NO: 111721 - DNA, 201 bp, Bos taurus
aagataaaataaaaacataaaaataggcctatgtaagaaacaaatcacagttttctacaaggcaaatagcccagctgataaatcatttttgttctgtctgycctgtgtgaagaggctgaagagatgacacatctcttaaataaatctggaagcttttctcatttaaactatctttgctgctatatttattccagaaactaa

SEQ ID NO: 111722 - DNA, 201 bp, Bos taurus
ccaggcccagctcaagtaagtgatctgaatctggcttcaggaaaaaaagaaagcatttatgctctgagtgcacagaatgaaacactgataaacagttcttkgtaaaactttgaattcagatggcattatttttcttcttaagccataagttgtcttttaaagaaaaaaatacatgtagcaaataaaataaaagaaaaggaa

SEQ ID NO: 111723 - DNA, 201 bp, Bos taurus
tgatatttgataaaagcaaagtaattttgcaaatgttatagagatctcaaaccactgacttttagttaatcacaatggaaattatcttgggtgggccttamctaatcaggtgaaaccttaagtggagctggaccttcctgaagctgggttcaaggcatgagagagtctccttctggctttgaagaagcagaaagccatgct

SEQ ID NO: 111724 - DNA, 201 bp, Bos taurus
ttacatatggcatacatttctcatggtgatcaaatactaaatagattcctgatattacaaaatgacagttcatttatggataattggaaaggaaatgcaaraataaatgaggtcctgtgaatatactaactaataactagtaactaatagtcagaaaaataaatcagtatgtagatagatgccataatgcaatttcctttt

SEQ ID NO: 111725 - DNA, 201 bp, Bos taurus
gcctattaattgtgagactgtacctggtctcagcaataactcaggagtccaactagaaccccattgcctttctggaacatctaaaagaggccctacaaaartttgccagtgttcacttagattcttatgagggatcagatcagatcagatcagatcagtcgctcagtcgtgtcctactatttgcaaccccatgaatcgcag

SEQ ID NO: 111726 - DNA, 201 bp, Bos taurus
ggaaggtaagttggaatttacagaaagggaagagaaagctaaggaagaacagatcataacttttagctaaaatgaagttgtcaatggaaagagagtgaggkccagtttacacaggcacagtaagcaatgtgagaaagtttctagcaacttaattcacatagtgtctttattcagtttgatgaaaattggactatggttaga

SEQ ID NO: 111727 - DNA, 201 bp, Bos taurus
tttaaatgaaaagctacattctctactggtaataagatttaattcatctaattataactctgggccagagtccaccaataccttgactgatgccatctgtrcactactgcccataccatccctcaccctttcaattgcttcaaacataattcaagaatgtagttctaaagccatactgtgattttgtacttaaagtggttg

SEQ ID NO: 111728 - DNA, 201 bp, Bos taurus
ctcagtcatcataaaatgagaaacctatttgctttctcaactaactctattatatagtaaaattcatagcaaataggtactcattgaacttctaaggaagmtatcatcatgatgatttgcttatgtactttttgttcatatatgcatatgtacacatgtgtgaggctatttgcattttcattgctaaattaatagaattat

SEQ ID NO: 111729 - DNA, 201 bp, Bos taurus
taatgaagctgctttgttgacaaatctatcatataattacatcactaatgtagcttttttgttatcaaaaatcagtccagaaaggccaaatactaacaatrttttgagttgcttgaataatcatacattgatatgaactttattaatgatcaaaatttatataaaaatcattgcactttcaattcatgcaaaaactctatt

SEQ ID NO: 111730 - DNA, 201 bp, Bos taurus
tatgtaatgaaagacagggaagcatggtgtgctgcagttcatagtgtcacaaagagttggacatgacttggggactgaacaacaagaacataaatgttggktctggtacatagcaaatatgagggaattaaatgagattagaagagaggaaaagaagagagaaggaggaaatatccttttcattaaacattttttttaact

SEQ ID NO: 111731 - DNA, 201 bp, Bos taurus
aaagactgttttactatatttgttaagtattcctttgttttgatgttatcatgaaatcaaatttttctactatcccagttgcagtatggtaaactacactrttttggcgattacttttcctttcttctaactgattacaaaccaaattataaaatgctggaagcattcaggcttaaataagttttcaactttaaagcatga

SEQ ID NO: 111732 - DNA, 201 bp, Bos taurus
cataaagatggggtattgtatgatcccaggtatattctgttgacattttaatgttttaaacgacaaattatatcaacagaaatcccatatgtaaaaggatrttctttaaccatttagtccattgtaattatcaaatctttggttgaaatcaagtacattttacagtcttgtttcatagtgtgcattttcgtatccttgctc

SEQ ID NO: 111733 - DNA, 201 bp, Bos taurus
cagttgggcgttaacaacctttatagagagaacacaatacatactgaatattaattatattctatgaatgcagatatatatgaaatacagatatattttckcaatcacagcacttttgccaacatatatttcttaaaaattcaaccattttcaagctaaacttatcaattaaaaaaccctagttttatttcaactcataaa

SEQ ID NO: 111734 - DNA, 201 bp, Bos taurus
ctctgtgagttagtgaagcacagggaggcctggcgtgctgcagtccatggggttgcaaagagttggacacaactgagtacctgaactgaactaatggtgtkcaaggccagtagaatctgtacttacagctttagtcctataaagaatagaggtggtaatgccattttaatatatcgatattttcacaacaaagattccttc

SEQ ID NO: 111735 - DNA, 201 bp, Bos taurus
tacactactactatctcactagtccccttttctcagtcccttttccaacataattcttatctcctatttttctcttaagtgggttacgtcctacaggttcrattctctaccattttattagagtaggtagtacatttacagttattataatgtttatatcattatatcatgagtttgagtaagctccaggaattggtgatg

SEQ ID NO: 111736 - DNA, 201 bp, Bos taurus
ggagtttcatttatttttgtgaaagtttcctttgagtaaagtctttggaatttcttttactcccttgatttttttttttccccagagactcattttgtcartattctggaccttttttttaacctatctttaatacttgccccttattttcaagcctatcaaattcttctttcatttattttccttttgattgtttttatt

SEQ ID NO: 111737 - DNA, 201 bp, Bos taurus
ttgccattctttggctatgaggtcagttcttcttgcctgtgaagactatccaggattcaatgctgcctcactgggtaatatgagaagatgattctaatgawgacttcactaatggctctcaccagttatattttttaaggaaaatcaatggcttaagtagaaaacatgaccatgacttacaatgctgaataaagaagagtg

SEQ ID NO: 111738 - DNA, 201 bp, Bos taurus
ttttctccccagctccccaaaccctgtccctctccatgtccattcccctaatcaatttcatatctctggcaactaatttccccaggaaatgatgctatagyagaaccagagaacagcatattggaacaatacaacacatctaagatttagtgaataaagattctatgggttgagaggagtaaagaaaatttaatcagtaag

SEQ ID NO: 111739 - DNA, 201 bp, Bos taurus
gagtctctctcatactttgactctctgctggctcttctgtcatcagatctttgaccattctgccttcctcttcagttttgggaacacatatcattgggccyatccagaataatctccctactttaagtcttaattccatctataagatctcttttgtcttgtaaaatatcatatttaaaggttccagggattagggcaatt

SEQ ID NO: 111740 - DNA, 201 bp, Bos taurus
aatattttattgtatctggctctgtatctatcttccagctgcttgggactgatgtgatacttgaaatgataaacacaagattgaatttgtaacaggtataytttttatagtttttcacatcatcttcaaggtattttgggcacttgtagctttatagaattagtagcaataaaaataagtaggatggataaggacagtccc

SEQ ID NO: 111741 - DNA, 201 bp, Bos taurus
acttaatgggatatatgcaaattttccaaacacagcctgaaactgtcatacagctgttgttattttaagatacgcatgatctcctctttctgttctacccyctttgttttcactaagtggtggcagcatgtttgcaagcctagtctggcctatgagaaatggcaatagcatttgctgggttccactgagaaggatcattac

SEQ ID NO: 111742 - DNA, 201 bp, Bos taurus
aaatgggaagttttagtgcaaaataattcagtttaagtaatgacaaacctggaagtggtgctgaaatgggattccaaaaggaagtagaatccacactctamaaagagtttgtattaagctgttaaatggggaaaacaactcaaaagttaaatttcttaaaaatctcaaggaaatctcaaagacctaccggcctctgaacta

SEQ ID NO: 111743 - DNA, 201 bp, Bos taurus
cagactgcacagatttgaaagctgatggccattatatgggggggaaaagcatttgaaaacatttgagtttagtactgagacaagagaaatataaactgagrgtggtttctgttgggaacttgaaaatgcttctgctgggtaaggctgctaatgtcaaagagaaaggaaagaaaagagcaaagatatgtatttctttagctt

SEQ ID NO: 111744 - DNA, 201 bp, Bos taurus
atcagatggtggcgtgtttatttcagtctgtcacagaagaggaacaagaaaacactgctgggccatgcaatttggggtataaaaatactaagggccaaaasaaaaactaaagacgttctgcctacttgactaaactcctaaatacaagggttgggggagaattcaggaggggttaagagaagcatgatggctcagtagtga

SEQ ID NO: 111745 - DNA, 201 bp, Bos taurus
tgggcacagaccatgtactctaatcgatcataatccctcctatgattcctgcttttgagttgatggccaatattccaaaatatgtagcatctcagagagtrtgagtttcatgtcacacagaaagacttttagaaattggagactctgagactcaattagtaaacatatggaattaccaacagtgctgacaagtacaattgc

SEQ ID NO: 111746 - DNA, 201 bp, Bos taurus
gccagaattatctaaagaaaggaatcagttcacttctttgtatatacattgctttatagaatgaaagaactattgaagtgaaagagacaccttagatgccrtctggccaagcctctcattttatagatgaggcaactggggttcacagaggttaagtgctttgctgacagtcacttattcttgcagaaaccaaggtcctga

SEQ ID NO: 111747 - DNA, 201 bp, Bos taurus
tgactaagcgactgaactgaactgaactgaaacatagtgtgatggttaattttatgtgtcggcttgtccggactaagggatgcctaaatagggaacagtgmaatattatttactggtgtgtctgtgatgtatttctggaagagattagtatttgaatctggagactaagtgaagactacccttaccagtgtaggtgaggat

SEQ ID NO: 111748 - DNA, 201 bp, Bos taurus
caaattaaatatttttaagttggataatcactctaataagagtaaatttagaggtagtcaggaaatttgggctaaaaagaaacttttcccaagttcacccrtggctccatctcccatcacagtgttcaatctatggctgtatttccacaaatcattttgcttttatatcagagagagaaatgctaaaggtaatcagtggga

SEQ ID NO: 111749 - DNA, 201 bp, Bos taurus
aagatgctaagattgtgtcagggaattataaaaagtccagtacaactagattaggaagagtgaaaagatgctgttagaaggtgagcccaacaaaactgatrgtttcagagacttagtgaagtaaaaatgttagtcactcagtcgtgtccaactctttctgaccccatggactgtagcccaccaggcttctctgtccattca

SEQ ID NO: 111750 - DNA, 201 bp, Bos taurus
ctttgcaacccctatggtgtaacaggcctcacatagttcattaggaccacaaatttatatggtcaggaaacaaggtttcaatgatctttacaggaaaaaawttccagtgctgtctttagatgtggcaaaaagatgctctggaaaaggagacatccaagtgataagggctaaaagctgtagagaataaaagaatgaggaacc

SEQ ID NO: 111751 - DNA, 201 bp, Bos taurus
caggaatatggtttcatttcctattgggctgcaatttgccatgtatcagcatccaagggccaggctgctcaacctgaaaatgattattttctttcttttcmttaatgtatcggaagtggatctaaaagaacctgcactatacaggggggttaattatcctggcagtcagttaagctttgtaagttttaggtgataagaaca

SEQ ID NO: 111752 - DNA, 201 bp, Bos taurus
atggttgctctggagtataaaactttacctccaatatactgccaaaaatactgaatgattccatacaacatgttatttgagcttttacagaaagcagtttyctgagattttctttctttatgcccttgtgttttcttgactttttttacccagttccagtttccttagatatgttcagaggataacatttttaggacacat

SEQ ID NO: 111753 - DNA, 201 bp, Bos taurus
tgccatttccttttccagaggatcttcctgacctagggatccaacccaagtctccttcatcccctgtattaacaggcagatactttatcactgatccaccyggaagccatttctatattacaaattgatatattgacatataactagctaaaggctaaaaggcagcatagtattattctagagtccggggcagtatctgac

SEQ ID NO: 111754 - DNA, 201 bp, Bos taurus
aatttggatatatgcatatttttggttttccaagatgaataagttgtagagatctgctatacaacacagttaacatacaactggttaacaaaccagtatcraacactgcaaaatactattcacttgtacattatatgttgagacaggagaaactaggatgaatagaaacaatcaactttatccagattttttaatatcata

SEQ ID NO: 111755 - DNA, 201 bp, Bos taurus
gtttactacactggccttaaaaatcccatgaccacatgagaaatgtttgcaaagcagcacaagagaaaagtaatctacaaaacagtacacagttattaccrcaactttgcacttagggcctcacttgttctcttttttcaggccccttttaagcaggaagtaaccaaaacagccacatagggataccctacagatcaaaat

SEQ ID NO: 111756 - DNA, 201 bp, Bos taurus
cctttcacaagttaaaagcagcaaggcttattgtaaagactaaagtgagtttagttatgtcacattccagtacttgcctttcttttggaatctctttaggragaaagaagggccagcatttaagaatactggtcctcataaagacatgaatgggcttgtcttcctcttttctcctaccctttcaataactgttattgttca

SEQ ID NO: 111757 - DNA, 201 bp, Bos taurus
tagaggtccaatggagaagcactgtctagaacatagcaaacctcaggcacacaggatccacactaatattatacatggaagagagacctggggattccttrgaagcctgggaaccctgatgtgtatttctttgggttcattatttggaaaagcttaacttaatcaaaccacaggtctactaaatttactctttagttcata

SEQ ID NO: 111758 - DNA, 201 bp, Bos taurus
caagaatacaatagcatcttactaatgaggcatatttttctgtaatctatatgtggaaacttggttttgggaaatactttgactcatcagctctttttccycttagtaattttttgcaaaagaaacgctacacatacatcatgactaatcaaaattttgttctggccctgccagatatcagtatgcttcaaattaacagag

SEQ ID NO: 111759 - DNA, 201 bp, Bos taurus
ccaggaactgcaggccctgaggctgcctaacctcccaaagtgcctttgcaaccagatggacaggagaaggaccttgccttcattctggagatccatatctrgagattcatacccagacaaatgccatgtctaaaggatatgctgaaaatccaaactccagaaaagtgtgaaatttctcttggaactgggcctctaaataat

SEQ ID NO: 111760 - DNA, 201 bp, Bos taurus
ctgactattctttctagtccttaaatgcagggttcccccacagctctggtcttgtcatttttctcttattactctgagtaactggattttatttccatggmttcaaagtactcagaaatcccattctgtaggtcccaattctaaatgctcacctacctcttacagatagccagctgaattgccccacagatttcaaactct

SEQ ID NO: 111761 - DNA, 201 bp, Bos taurus
tctctggtggtgccattatatattccataagtatgccttgtgaatacatttaaataaatcatttgccattagtgtttcaaaagatattctggcccacagaycacaaatctctccagaaacacatcagattcatttttaaaactccaggaagtccatttccaactttttgtttaatgccttccttaaacaggaactgagttg

SEQ ID NO: 111762 - DNA, 201 bp, Bos taurus
agacttacaagatttatcttctgcccacctttctagattcctttcccaccactctcttacttacactgtgttcccaagatgtatcaaacaacttacagttycctaaacaggccccactttccaccttgacccatgttgttccctccactgggaaaaaccttttttcctattcctgatggaccttctgcaagcacacttctg

SEQ ID NO: 111763 - DNA, 201 bp, Bos taurus
tatacaacgtagaaaaatatgtgtatacattgtaagaccacaatgctaaggagggagggtgtacaaatctctcaagaggccagaaatggtaggatgaagcrgacttccaaccgcggcgctacatagggacacctttcctccttgggtaggaccaagttagacaacagcaggggttggtccgggggccgcccttagaagacg

SEQ ID NO: 111764 - DNA, 201 bp, Bos taurus
tttattactctttgctatcaacactgtactcatatctgatttttacatccagtcatccttgttgtttttacttctttgctactttaggataaagatacagyattcactaagttatttaataaatgactagagtagatctaagattcaacatgatgagagtcattagcataatatgctagtcatacatttgattaaacctgg

SEQ ID NO: 111765 - DNA, 201 bp, Bos taurus
ttgaacgtctgtatgaggtgtttaattttgaaatacctgacccatgacagtgttagggattggtgatatacggttaatatgcatggagagcacttctttawggccttggacttctcatgactgaaagtttgaatatgaagacagggagaaggaatctcatctgagctttggtactttcctcgatggaaaaaacaactcagc

SEQ ID NO: 111766 - DNA, 201 bp, Bos taurus
attgtaatggcctctattcaaatgttcttgtgttgaaataacagactccacggatgggccagccgtggctttgagttgcttcggtcttaaaagctaggagraagctgatgacaaagctggggagagagggaaaaggtatgtaacataatgagtatgactcaggcttcaaatataatcggatattgaaatcactgaggtctg

SEQ ID NO: 111767 - DNA, 201 bp, Bos taurus
aatcatattttcctaatgtacccttattcaattataaagttattttcaagtacagttactttctaatatcaaagaataccacttggccatctatgtcattygtcatgcttcttaattgcagattgtttctgagccacttttttcttcacttttaagtagggtgaaacttccataaatcagaatctactgaattatcccatt

SEQ ID NO: 111768 - DNA, 201 bp, Bos taurus
aaaatataaattaaacactagaattctcttcaaagcacacacacctgtcatcattacatggatcataaagagacgtcacagtttaaaaaacagaaacagaytcaaagacatataagacaaattatcaaaggcatagtaaggttaaattaggagtttgggatgtgatgaggacacagcaggaagacaaatctgctgggctgg

SEQ ID NO: 111769 - DNA, 201 bp, Bos taurus
acagaggctttaaaggtgatggaatagcccctcaaagcctattttgagcaggactcctgcagagggccctgggagagaaggaggtagaagttgctcatgaraatataaaatgttaatgaagaatttggaacataagcaagtgtctaacgatgtgacagtgcataaagcttttccaaggaatctgatgaacagccagttttg

SEQ ID NO: 111770 - DNA, 201 bp, Bos taurus
ctcccagcaccagaatcttttccaataagtcaactcttcgcatgaggtggtcaaagtactggagtttcagctttagcgtcctacattatttagtgatttaytaaaattcagcttctgtcctacctcactaagataaaaaaaaaaattcgcttcctaattcctcaatccaattaactccagtttcaattcacgtttcttttc

SEQ ID NO: 111771 - DNA, 201 bp, Bos taurus
tttttgcgcggcgccccgagagggcgaaccgcggagggagggaccggccaacggcggccgggaggtggcggacgcgctggccaagccccggaaaaaactgyagaagtcttgagaagaacaagggagtggaaaaattagactagtttgagtcttggttgggaaggtgagtactaggtagtatcatcagaaagaaagtgtatt

SEQ ID NO: 111772 - DNA, 201 bp, Bos taurus
attttcattttgaatggattttccgttccaagatagttagtcatttatgccctcaaagcacttttcaaattctgttattgtaccaaacatattcatttatrtatttattgttcatccttgcttctagaccataaattttccagaacgggaactgtgtcttattactgtttataccctacaagcccagcacattaagtgagg

SEQ ID NO: 111773 - DNA, 201 bp, Bos taurus
actgctgcctgaggccacagagctgtgtctcactttggcagcacatataccaaccctggaatgagttcagaaatattagcatgactcctgtgcaaggataytcagtgttttatttgaggttttggccactggagtaaggcaagaaaatgaaataaaagctgccatgagtggaaagaaataagcaaaactgagtattcagag

SEQ ID NO: 111774 - DNA, 201 bp, Bos taurus
aacaataatctagacaaagggtcaggcactgaaatgcagttaaagtataagaaaagtgtcctacctaagtgcatttgacagaatggagagaaggctcagcycttcaagacccagacacctgcctggagacagattttggattcttgtaacaaggtgtcttttctgctattttcaaggtagattgaaggaatacaaaataga

SEQ ID NO: 111775 - DNA, 201 bp, Bos taurus
tgcagggaggaggtaagagcctttaatgttcagttgcagtccaccattcctgaggactttattctttgaagttcagtttctccttgggaattcacaagggrgatggcttaagtccgaatatgcagcagtgttttttttaccagagagtctttaggttgcagaatcagtaaagagctaaattagccatggtgatggaaatga

SEQ ID NO: 111776 - DNA, 201 bp, Bos taurus
gatattatatctatgaaattttaatgcttcaatttggcccacatggcatgaattagtgagccaagattctatcaggtccccttttcacaagaagaaattaycactaaaagattaagaggccacagctctcactaaaggttaccttcccagctgaaggatgcaatggctatggaaacctagcatggccttcctacaaaacaa

SEQ ID NO: 111777 - DNA, 201 bp, Bos taurus
ataaagtgaggagaatgagaggaggccatggggtatgctcacatagaagcctggggtccagctcagcccctgactggtgcctgctgtgaaacccttctccytccctttctagggcctcctctacatgccttgctcagcaaaacttgctttagtggcagatttctggatatcatgcttcagcatactgggactcaagcaaca

SEQ ID NO: 111778 - DNA, 201 bp, Bos taurus
ttccttctcactatggttttaaatttgcaaaactttgatttctaatgagactaggaactccttcatttatttacttccctgaatccagattccttaaaatkttaaatttcatattctaaacttttgtattttggtgttgttcatactagacatttcgtgacataactgataagtacaaagcaagcaaaagaaactcattca

SEQ ID NO: 111779 - DNA, 201 bp, Bos taurus
cacacacatatcccaggccctgccaaagggcacttttttccccctaatcacaccattcatgaatttttgcccttgtgggagtgctttcatgcctgttgagratgcatgacttcagctatttattctttactaggtacctgctgctgctgctaagtcacttcagtcgtgtccgactctgtgcaaccccatagacggcagccc

SEQ ID NO: 111780 - DNA, 201 bp, Bos taurus
actgactgaggctgtggcccccacgggccccacttctgccttggacagctggcagacattaccccaggcaccacagctgaaaccagcactttcatatgccrcactcacttgataatggccactacctgtctctaacaagccatcaagatcactagtcatctcttccccacaaaggctcctcctgtatctcctgtaacaaca

SEQ ID NO: 111781 - DNA, 201 bp, Bos taurus
tctttgcataaggcctaagtcatctcttaacttatttttcacagtattgcagatatgctactaccaacatgcatgtttgatcatttcacagtcttaaagtmatggccctccatcacctctgctgttgctgctactgctaagtcgcttcagtcgtgtccgactctgtgcgaccccatagacggcagcccaccaggctccccc

SEQ ID NO: 111782 - DNA, 201 bp, Bos taurus
gctagaagtagaatgttttaaggtagttatttgaagacagtaaagcttttttcttttccagtttttttacatttgaataattccttagtatgaaaaataayaccttcagtattgttttggaagccaaattttaattgcatgaaatttcaaaagtttgtctctcaaatgttactttactacctataaagctttatctatatt

SEQ ID NO: 111783 - DNA, 201 bp, Bos taurus
attttctctaaatctcatttcacaatatccagcttacagaataagtcgaaaattacagtttagagcatttcattttgtaatgcattatagacattgttttytgaatagttgcaactctgttcctcatagaaagcttatgtagtcaaccctttatttaatcagagtaccctttatatgtgcatgtagaaagataatggagag

SEQ ID NO: 111784 - DNA, 201 bp, Bos taurus
tgtgtgaaatgagctattggaaggctgagatctgagtagctgctaaaaagctagatggcacagtagttagaattgtttttgtcacagtgtctatggataarccattccacctttcaaagtgaggggcacaccttgaatgtcttcaatgagtggcaggtggacttttcaagataactaacctgctgctgacaatgaccctga

SEQ ID NO: 111785 - DNA, 201 bp, Bos taurus
ttactaatgttaccatttcattaaaacacaaatgcacgtatatatacaaacacaacacaatttagagcatatcattttgtagacttggggtgttatacagsactattaagtctggtaagttagtatgaactatttcctgacaccaacagattctccacttggatggatttttttgctgtcaagagctaggagctaaatgtc

SEQ ID NO: 111786 - DNA, 201 bp, Bos taurus
tggaaaatgatgcttttaagtaatgtgaaatttcagtacctattcctgaaaagcaagaacctggtaccatctgaggtatcaggcagttgatgacagtagcytctgtgaactaggatactttatagactgtggttccaactgaagagcaaggtgtaaatgtcacatgttttcttaaagtctatagctgagagtgtttccaaa

SEQ ID NO: 111787 - DNA, 201 bp, Bos taurus
taagaaaacaagagaaaagaaagcatcataatttgtatgatacagtaatttggtattttgtttcctttatctcaagaagaagaaacctgctcatgccttgrtaacaccatttatctgtcagatggcgtaggcaggagtcagctgtttcccataaagatatcttgggaaacagcaacggtgctgtctacactggcagatgct

SEQ ID NO: 111788 - DNA, 201 bp, Bos taurus
tctataaggatatttccttgaatcatggaaattgtatgtgaataagagtgtcttatgctcctatggataaaaccattaaggagtattacattataaacatrgtatatactttttttctggatcagaaagtcagaatttagtaagatgaagaaaaaaaaaaaaaaaaacctcagtaagacttaagaattaatcaatttagaa

SEQ ID NO: 111789 - DNA, 201 bp, Bos taurus
agggggaaacagtgctgagttttgtcttgcttctatttgtactttctgtcctcatttaaatcacattcctttgggattatgttgtgtatttaaaactgtgkagaatttgtgaacacagccaacatcctgatatgttggtggggagtgctctgttttattgttagcaaaataaatagaagaaaaaatagttgacacataata

SEQ ID NO: 111790 - DNA, 201 bp, Bos taurus
atgaatattcaggactgattccctttaggattgacaccctttgggatgtgactgtgcacaaaaccacacacagttttttgcatggttctgtgtgtatattkcataaaatatgttgatttttaaaaataaaatatgtattattaagtaggaagctaatcacactcatacatttcaagcataatatttgctcccaggattcag

SEQ ID NO: 111791 - DNA, 201 bp, Bos taurus
ctacagatctaaggctcttactgcttctttttagtctgagcctagagaaccagatatcaaaaaatattatatattttctattctctttagaccccaacacrttgcattgagttactgcaaatcacaaggctaaaaacctcctcatctgtcatcagccccagttcataacatgacacagccattgtggagagaatgactatg

SEQ ID NO: 111792 - DNA, 201 bp, Bos taurus
tctgacttggagcagtaggtgttggctcggtaactgaaaaacgcagcaacaggagtcttcagtcaccagatgaaccaaaacaaggggctcaccatgcacayacttctcaacgtttactactcagatgctaacatttctcatttgcttgcttaccgttttatagccactattttatttctgcatcgtcctttatacactttc

SEQ ID NO: 111793 - DNA, 201 bp, Bos taurus
attttcctgaagaatcaggaatataatatcactctacaaataagtctattgggcacctgacccctaacctttttctccttgtttttcattttccacccatyccctaggtctcttagctccatccacacacattatggtcttgttgctgtacttcctatagtcagataggtttaatatatatgatttcctcttcctagaaag

SEQ ID NO: 111794 - DNA, 201 bp, Bos taurus
ttgtactaagatctgtatttaacttaaacaatgaagatcatacagtgttactcgcctccttcttgtctatcattgggccgtatccatgtagcgagggtgaycatatatttttttccaaactacgtcacttctgaagctaaccttcactaggatggtaggcataaagtgggactatccatggcaaaccagggtgcatacata

SEQ ID NO: 111795 - DNA, 201 bp, Bos taurus
actttgctttaaagcttgtatttatattttttcctgacttttctccaaactcatttatgtcagggcctatattgtcttcatgtttgattttatagtggccracaaagtgctgacacatggtaggtatccagaaaatattttgtcaagtgaattgtgtcataaggtatccaaagcttaattaataataatggccttctcaga

SEQ ID NO: 111796 - DNA, 201 bp, Bos taurus
gtttagtagtaggaagttagtagtttagtacaaaaacagatgtttaaatgaatgtgtgcaacatcatgtgataaatgctatctatgatatagatagataaygtgagctgacaaagtatgctttgaaaatcaaagtaccacttaggttggactgtgttctgcttcatgccaggagtgaggtttggggatctgaactgctaac

SEQ ID NO: 111797 - DNA, 201 bp, Bos taurus; identical to SEQ ID NO: 30768

SEQ ID NO: 111798 - DNA, 201 bp, Bos taurus; identical to SEQ ID NO: 30769

SEQ ID NO: 111799 - DNA, 201 bp, Bos taurus; identical to SEQ ID NO: 30770

SEQ ID NO: 111800 - DNA, 201 bp, Bos taurus; identical to SEQ ID NO: 30771

SEQ ID NO: 111801 - DNA, 201 bp, Bos taurus; identical to SEQ ID NO: 30772

SEQ ID NO: 111802 - DNA, 201 bp, Bos taurus; identical to SEQ ID NO: 30773

SEQ ID NO: 111803 - DNA, 201 bp, Bos taurus; identical to SEQ ID NO: 30774

SEQ ID NO: 111804 - DNA, 201 bp, Bos taurus; identical to SEQ ID NO: 30775

SEQ ID NO: 111805 - DNA, 201 bp, Bos taurus; identical to SEQ ID NO: 30776

SEQ ID NO: 111806 - DNA, 201 bp, Bos taurus; identical to SEQ ID NO: 30777

SEQ ID NO: 111807 - DNA, 201 bp, Bos taurus; identical to SEQ ID NO: 30778

SEQ ID NO: 111808 - DNA, 201 bp, Bos taurus; identical to SEQ ID NO: 30780

SEQ ID NO: 111809 - DNA, 201 bp, Bos taurus; identical to SEQ ID NO: 30781

SEQ ID NO: 111810 - DNA, 201 bp, Bos taurus; identical to SEQ ID NO: 30782

SEQ ID NO: 111811 - DNA, 201 bp, Bos taurus; identical to SEQ ID NO: 30783

SEQ ID NO: 111812 - DNA, 201 bp, Bos taurus; identical to SEQ ID NO: 30784

SEQ ID NO: 111813 - DNA, 201 bp, Bos taurus; identical to SEQ ID NO: 30785

SEQ ID NO: 111814 - DNA, 201 bp, Bos taurus; identical to SEQ ID NO: 30786

SEQ ID NO: 111815 - DNA, 201 bp, Bos taurus; identical to SEQ ID NO: 30787

SEQ ID NO: 111816 - DNA, 201 bp, Bos taurus; identical to SEQ ID NO: 30788

SEQ ID NO: 111817 - DNA, 201 bp, Bos taurus; identical to SEQ ID NO: 30790

SEQ ID NO: 111818 - DNA, 201 bp, Bos taurus; identical to SEQ ID NO: 30791

SEQ ID NO: 111819 - DNA, 201 bp, Bos taurus; identical to SEQ ID NO: 30792

SEQ ID NO: 111820 - DNA, 201 bp, Bos taurus; identical to SEQ ID NO: 30793

SEQ ID NO: 111821 - DNA, 201 bp, Bos taurus; identical to SEQ ID NO: 30794

SEQ ID NO: 111822 - DNA, 201 bp, Bos taurus; identical to SEQ ID NO: 30795

SEQ ID NO: 111823 - DNA, 201 bp, Bos taurus; identical to SEQ ID NO: 30796

SEQ ID NO: 111824 - DNA, 201 bp, Bos taurus; identical to SEQ ID NO: 30797

SEQ ID NO: 111825 - DNA, 201 bp, Bos taurus; identical to SEQ ID NO: 30798

SEQ ID NO: 111826 - DNA, 201 bp, Bos taurus; identical to SEQ ID NO: 30799

SEQ ID NO: 111827 - DNA, 201 bp, Bos taurus; identical to SEQ ID NO: 30800

SEQ ID NO: 111828 - DNA, 201 bp, Bos taurus; identical to SEQ ID NO: 30801

SEQ ID NO: 111829 - DNA, 201 bp, Bos taurus; identical to SEQ ID NO: 30802

SEQ ID NO: 111830 - DNA, 201 bp, Bos taurus; identical to SEQ ID NO: 30803

SEQ ID NO: 111831 - DNA, 201 bp, Bos taurus; identical to SEQ ID NO: 30804

SEQ ID NO: 111832 - DNA, 201 bp, Bos taurus; identical to SEQ ID NO: 30805

SEQ ID NO: 111833 - DNA, 201 bp, Bos taurus; identical to SEQ ID NO: 30806

SEQ ID NO: 111834 - DNA, 201 bp, Bos taurus; identical to SEQ ID NO: 30807

SEQ ID NO: 111835 - DNA, 201 bp, Bos taurus; identical to SEQ ID NO: 30808

SEQ ID NO: 111836 - DNA, 201 bp, Bos taurus; identical to SEQ ID NO: 30809

SEQ ID NO: 111837 - DNA, 201 bp, Bos taurus; identical to SEQ ID NO: 30810

SEQ ID NO: 111838 - DNA, 201 bp, Bos taurus
cagaggtatttccttaggtttcttagtcaggcctacaccggtgtaaaccagaggtcagcagaattgttctgtaaagagccagatagtaaatatctaatctygtgggccacatagtctctgctgtaactactcaactctgacattgtagcacaacagtatcatagagaacatgcaaacaaatggatgtggatgtatcccaat

SEQ ID NO: 111839 - DNA, 201 bp, Bos taurus; identical to SEQ ID NO: 30811

SEQ ID NO: 111840 - DNA, 201 bp, Bos taurus; identical to SEQ ID NO: 30812

SEQ ID NO: 111841 - DNA, 201 bp, Bos taurus; identical to SEQ ID NO: 30813

SEQ ID NO: 111842 - DNA, 201 bp, Bos taurus; identical to SEQ ID NO: 30814

SEQ ID NO: 111843 - DNA, 201 bp, Bos taurus; identical to SEQ ID NO: 30815

SEQ ID NO: 111844 - DNA, 201 bp, Bos taurus; identical to SEQ ID NO: 30816

SEQ ID NO: 111845 - DNA, 201 bp, Bos taurus; identical to SEQ ID NO: 30817

SEQ ID NO: 111846 - DNA, 201 bp, Bos taurus; identical to SEQ ID NO: 30818

SEQ ID NO: 111847 - DNA, 201 bp, Bos taurus; identical to SEQ ID NO: 30819

SEQ ID NO: 111848 - DNA, 201 bp, Bos taurus; identical to SEQ ID NO: 30820

SEQ ID NO: 111849 - DNA, 201 bp, Bos taurus; identical to SEQ ID NO: 30821

SEQ ID NO: 111850 - DNA, 201 bp, Bos taurus; identical to SEQ ID NO: 30822

SEQ ID NO: 111851 - DNA, 201 bp, Bos taurus; identical to SEQ ID NO: 30823

SEQ ID NO: 111852 - DNA, 201 bp, Bos taurus; identical to SEQ ID NO: 30824

SEQ ID NO: 111853 - DNA, 201 bp, Bos taurus; identical to SEQ ID NO: 30825

SEQ ID NO: 111854 - DNA, 201 bp, Bos taurus; identical to SEQ ID NO: 30826

SEQ ID NO: 111855 - DNA, 201 bp, Bos taurus; identical to SEQ ID NO: 30827

SEQ ID NO: 111856 - DNA, 201 bp, Bos taurus; identical to SEQ ID NO: 30828

SEQ ID NO: 111857 - DNA, 201 bp, Bos taurus; identical to SEQ ID NO: 30829

SEQ ID NO: 111858 - DNA, 201 bp, Bos taurus; identical to SEQ ID NO: 30830

SEQ ID NO: 111859 - DNA, 201 bp, Bos taurus; identical to SEQ ID NO: 30831

SEQ ID NO: 111860 - DNA, 201 bp, Bos taurus; identical to SEQ ID NO: 30832

SEQ ID NO: 111861 - DNA, 201 bp, Bos taurus; identical to SEQ ID NO: 30833

SEQ ID NO: 111862 - DNA, 201 bp, Bos taurus; identical to SEQ ID NO: 30834

SEQ ID NO: 111863 - DNA, 201 bp, Bos taurus; identical to SEQ ID NO: 30835

SEQ ID NO: 111864 - DNA, 201 bp, Bos taurus; identical to SEQ ID NO: 30836

SEQ ID NO: 111865 - DNA, 201 bp, Bos taurus; identical to SEQ ID NO: 30837

SEQ ID NO: 111866 - DNA, 201 bp, Bos taurus; identical to SEQ ID NO: 30838

SEQ ID NO: 111867 - DNA, 201 bp, Bos taurus; identical to SEQ ID NO: 30839

SEQ ID NO: 111868 - DNA, 201 bp, Bos taurus; identical to SEQ ID NO: 30840

SEQ ID NO: 111869 - DNA, 201 bp, Bos taurus; identical to SEQ ID NO: 30841

SEQ ID NO: 111870 - DNA, 201 bp, Bos taurus; identical to SEQ ID NO: 30842

SEQ ID NO: 111871 - DNA, 201 bp, Bos taurus; identical to SEQ ID NO: 30843

SEQ ID NO: 111872 - DNA, 201 bp, Bos taurus; identical to SEQ ID NO: 30844

SEQ ID NO: 111873 - DNA, 201 bp, Bos taurus; identical to SEQ ID NO: 30845

SEQ ID NO: 111874 - DNA, 201 bp, Bos taurus
tgggaacctctatgtttgtcactgatcacaataagaccttcagagggtgatggccattcttctacttctgctcctcaaatctcacacaacttcctcttttyagttcagttcagtagctcagtcgtgtccaactctttgcgaccccatgaatcacagcatgccaggcctccgtgtccatcaccaactcctggagttcaccca

SEQ ID NO: 111875 - DNA, 201 bp, Bos taurus; identical to SEQ ID NO: 30846

SEQ ID NO: 111876 - DNA, 201 bp, Bos taurus; identical to SEQ ID NO: 30847

SEQ ID NO: 111877 - DNA, 201 bp, Bos taurus; identical to SEQ ID NO: 30848

SEQ ID NO: 111878 - DNA, 201 bp, Bos taurus; identical to SEQ ID NO: 30849

SEQ ID NO: 111879 - DNA, 201 bp, Bos taurus; identical to SEQ ID NO: 30850

SEQ ID NO: 111880 - DNA, 201 bp, Bos taurus; identical to SEQ ID NO: 30851

SEQ ID NO: 111881 - DNA, 201 bp, Bos taurus; identical to SEQ ID NO: 30852

SEQ ID NO: 111882 - DNA, 201 bp, Bos taurus; identical to SEQ ID NO: 30853

SEQ ID NO: 111883 - DNA, 201 bp, Bos taurus; identical to SEQ ID NO: 30854

SEQ ID NO: 111884 - DNA, 201 bp, Bos taurus; identical to SEQ ID NO: 30855

SEQ ID NO: 111885 - DNA, 201 bp, Bos taurus; identical to SEQ ID NO: 30856

SEQ ID NO: 111886 - DNA, 201 bp, Bos taurus; identical to SEQ ID NO: 30857

SEQ ID NO: 111887 - DNA, 201 bp, Bos taurus; identical to SEQ ID NO: 30858

SEQ ID NO: 111888 - DNA, 201 bp, Bos taurus; identical to SEQ ID NO: 30859

SEQ ID NO: 111889 - DNA, 201 bp, Bos taurus; identical to SEQ ID NO: 30860

SEQ ID NO: 111890 - DNA, 201 bp, Bos taurus; identical to SEQ ID NO: 30861

SEQ ID NO: 111891 - DNA, 201 bp, Bos taurus; identical to SEQ ID NO: 30862

SEQ ID NO: 111892 - DNA, 201 bp, Bos taurus; identical to SEQ ID NO: 30863

SEQ ID NO: 111893 - DNA, 201 bp, Bos taurus; identical to SEQ ID NO: 30864

SEQ ID NO: 111894 - DNA, 201 bp, Bos taurus; identical to SEQ ID NO: 30865

SEQ ID NO: 111895 - DNA, 201 bp, Bos taurus; identical to SEQ ID NO: 30866

SEQ ID NO: 111896 - DNA, 201 bp, Bos taurus; identical to SEQ ID NO: 30867

SEQ ID NO: 111897 - DNA, 201 bp, Bos taurus; identical to SEQ ID NO: 30868

SEQ ID NO: 111898 - DNA, 201 bp, Bos taurus; identical to SEQ ID NO: 30869

SEQ ID NO: 111899 - DNA, 201 bp, Bos taurus; identical to SEQ ID NO: 30870

SEQ ID NO: 111900 - DNA, 201 bp, Bos taurus; identical to SEQ ID NO: 30871

SEQ ID NO: 111901 - DNA, 201 bp, Bos taurus; identical to SEQ ID NO: 30872

SEQ ID NO: 111902 - DNA, 201 bp, Bos taurus; identical to SEQ ID NO: 30873

SEQ ID NO: 111903 - DNA, 201 bp, Bos taurus; identical to SEQ ID NO: 30874

SEQ ID NO: 111904 - DNA, 201 bp, Bos taurus; identical to SEQ ID NO: 30875

SEQ ID NO: 111905 - DNA, 201 bp, Bos taurus; identical to SEQ ID NO: 30876

SEQ ID NO: 111906 - DNA, 201 bp, Bos taurus
cccagcagtgatatcatacccttttattaagggccatatgatcccctgcaggaggcagtcagaaattcaaagcaatattatacatggctgtggttactgtrtgatgatgcaatggaagatgatcctcagtccccaggaggcatggatacaggattctgggactgtttttggccaccgctcagtttttgtcttgaaactgca

SEQ ID NO: 111907 - DNA, 201 bp, Bos taurus; identical to SEQ ID NO: 30878

SEQ ID NO: 111908 - DNA, 201 bp, Bos taurus; identical to SEQ ID NO: 30879

SEQ ID NO: 111909 - DNA, 201 bp, Bos taurus; identical to SEQ ID NO: 30881

SEQ ID NO: 111910 - DNA, 201 bp, Bos taurus; identical to SEQ ID NO: 30882

SEQ ID NO: 111911 - DNA, 201 bp, Bos taurus; identical to SEQ ID NO: 30883

SEQ ID NO: 111912 - DNA, 201 bp, Bos taurus; identical to SEQ ID NO: 30884

SEQ ID NO: 111913 - DNA, 201 bp, Bos taurus
taaccttaggcagaacctggaaagtcgagtatttgaccagatcatgctttgcttagcatttgtctcttttctcccagaagtggaatgtactatctttactrgtgagttaatacagattacagagggtagactcaattcagaaagtcttggtagtctatagccgtaccaccctgaactcacccaatcttatcaggaagtctc

SEQ ID NO: 111914 - DNA, 201 bp, Bos taurus
tgaggactctgaaacagcaggaggggcataaagctttacctccagaattctgggaggtgagcctggaagacaaggaactctacttaagatagacaagtctkggcacattaatccacaggaccaggtgaccaagaagaaagcatgagctgtgtggagggcggctgcttgaaacagctgctaagctcagccctgggtacttaa

SEQ ID NO: 111915 - DNA, 201 bp, Bos taurus; identical to SEQ ID NO: 30885

SEQ ID NO: 111916 - DNA, 201 bp, Bos taurus
ctgtcccggctccagcctgtgcccggaggcactcagcatgcctgggtctgcaccctgtggcctggacacgaggcacctccgttctggggtgcgggattgtyacactctctcctcctctcctgggtgcccgatctgcaagcagaccaggagctccagcagctccaacgaccatccgcctgagctcctgcatggatgatttcc

SEQ ID NO: 111917 - DNA, 201 bp, Bos taurus; identical to SEQ ID NO: 30887

SEQ ID NO: 111918 - DNA, 201 bp, Bos taurus
ttaaacaattaatctgcatttgcacagtattttcataaattagtaactctttatgatcatcttttgctccactgagtcttattcactaggtgttctttaamtatttcatgaatgaatagaagaaggaaggaaggagcattatttccactaccaagtccaaagggaattcagacttggccttttgtacaaagtaagtccact

SEQ ID NO: 111919 - DNA, 201 bp, Bos taurus
taagaagatgggaagggagacacacattcattcctggggaaaacatgaccaggtgtcttgagctgatccttaaatgaaagtttaaaaacaggaggtctacraggcagctccatgctgatcctgggctgtgttcccaactttgctgtattagttgggtgatagaatggagatgatgatttattccttgcctacttcatgaag

SEQ ID NO: 111920 - DNA, 201 bp, Bos taurus
tcatcatcatcgagacgagcaccatcaagccttaccaccggggcttttactgcaacgacgagagcatcaagtatccacagaaaactggggagacaatcaaygacgctgtgctcactgctgtggggattgttattgccatcctcgcggtaagtgcccagacttcgatgggcaacctgtctgattccctggcagcacatcatg

SEQ ID NO: 111921 - DNA, 201 bp, Bos taurus
ggcccacctccatctccttatttcacacgaaggacagtcaaggggtgcagtggacctcaggaaatgggagggcagctggtttcttgaatgctgagaaagayaggcattttcctctgggaatgagaattctgtgacgtactctgaatctctgttttctcttctgagatttgactctgggcgccttggagttgcccttcatag

SEQ ID NO: 111922 - DNA, 201 bp, Bos taurus
gtaagcccttggcatttataggctagagagagggctccaaagtggccactgtcagcacctgtatccttggggtaaaacgggctctccaaaatggctgcctycaatatctgtgttccgaggggaaactccacttgtttctgtctctctgggaggcttttcaaaatcagcagatggactgactcagtttcctttcgaattact

SEQ ID NO: 111923 - DNA, 201 bp, Bos taurus
caatggtgtaaacaccatcaatgaatcccaaaacagttttgggcacttatttccatgtaaattgtattacttaattctctgaaatgttttataggattggsagtataacacatagttttaaaatgctgttcctcttcctaaaagatctttcttccctttgctgtctgttaaatacacctgatctttcaggatccatctcca

SEQ ID NO: 111924 - DNA, 201 bp, Bos taurus; identical to SEQ ID NO: 30889

SEQ ID NO: 111925 - DNA, 201 bp, Bos taurus
ataagtagaagagacttacccgcaactaccttacagttgtaaggccacaaaaagagaaaaataattatgttaccttgtagtaaagcttgtaacagaggatytggtaagagatcaaggagaaaagaactaaagtgactttgagacctgtgtccatggttctgttctgagaacttcttatgaacatcgagttctgttgggccc

SEQ ID NO: 111926 - DNA, 201 bp, Bos taurus; identical to SEQ ID NO: 30891

SEQ ID NO: 111927 - DNA, 201 bp, Bos taurus; identical to SEQ ID NO: 30892

SEQ ID NO: 111928 - DNA, 201 bp, Bos taurus; identical to SEQ ID NO: 30893

SEQ ID NO: 111929 - DNA, 201 bp, Bos taurus; identical to SEQ ID NO: 30896

SEQ ID NO: 111930 - DNA, 201 bp, Bos taurus; identical to SEQ ID NO: 30897

SEQ ID NO: 111931 - DNA, 201 bp, Bos taurus; identical to SEQ ID NO: 30898

SEQ ID NO: 111932 - DNA, 201 bp, Bos taurus; identical to SEQ ID NO: 30899

SEQ ID NO: 111933 - DNA, 201 bp, Bos taurus
attttgcctcgttgcctcgtggggttgggcaccaaccctgaaacagagtagctaagccgtcaggagacatgctagttctcctttgcctctctctcattttwctctgcatgtatctaaatccccctttaccatctcactccttcttctgctgtctgttaaaactgaaggtctaactacagctaccagcttttttgttcctga

SEQ ID NO: 111934 - DNA, 201 bp, Bos taurus; identical to SEQ ID NO: 30900

SEQ ID NO: 111935 - DNA, 201 bp, Bos taurus; identical to SEQ ID NO: 30901

SEQ ID NO: 111936 - DNA, 201 bp, Bos taurus
gcatgactatcttaatgctcaattcatgagataagtatagagaataaaatgtgataacgcacataggaattttcatagcatctggcccccagcagttcccycagtaaatgtccatcctcactgttccttcctccctatgggtgacggttgggtggtggccttgagaaaaagaccaagtctggctttcagttctctgcaccc

SEQ ID NO: 111937 - DNA, 201 bp, Bos taurus
ggcagttaacactttgcactgtccagcttggccccaggctcctggaccaggcacaggtgaagggcagaggtgcagcctctccaggccatagtgtgtatgargttgaagcaggaggtcagctctgaatctgcattgtcagtgtgtgaaggtaggcagaggaggttggcatgggtgagtctgggtgggagagtgaggctactt

SEQ ID NO: 111938 - DNA, 201 bp, Bos taurus
ctacctttgcacggccctgtttgcattagaaagtttggcttaaggtcaggaagaatgtcagaacagggagacttctaagagacagccggttccatccattyctcttggaagtggagaatgtggcccagagaagacacccaagatcaaagagaaagtaacatgaatggggcaggaacccaggcctcctgactcccagtgcct

SEQ ID NO: 111939 - DNA, 201 bp, Bos taurus
gcagagcatttcagcgtcggggaagccaatacaatttgagttagtcgtgatggctgccactttaaataccgcggtgagtgtccgtcagcgactaatgtgcygcacagggcctcgcagagaacctgatcaccccagcgcttcagtcgattctgaccccgagctacagaaaatgaacttaaatctagtgggctgtcgccacgt

SEQ ID NO: 111940 - DNA, 201 bp, Bos taurus
gcggcctcccggctggaggacgacctcagcatcaatcaggggtgacacacagttcagcgccaccaagatcatcgtgggagacggcaggcccataaatcccygcctgcccagacaccagaggctgaaatatgtctgaggcgtttcccggagagaggttgagagttcctggcctctgcctgccagctccttccttttcctccc

SEQ ID NO: 111941 - DNA, 201 bp, Bos taurus
atgcaccatggccttctatatgccaagtcccatgacagcttctggggccacaaaaacattaagacagtctttccagatgcagacagtataccaggacacaygcatggaaaggaacacgtttccatcacaatactgtaaagtaattatcctccaattaaaaaagaaaaacaccttttacatagcacaagtacaacaagtgca

SEQ ID NO: 111942 - DNA, 201 bp, Bos taurus; identical to SEQ ID NO: 30907

SEQ ID NO: 111943 - DNA, 201 bp, Bos taurus; identical to SEQ ID NO: 30908

SEQ ID NO: 111944 - DNA, 201 bp, Bos taurus; identical to SEQ ID NO: 30909

SEQ ID NO: 111945 - DNA, 201 bp, Bos taurus
ataatttgggaatgtagccacttggcgaagtaatttgtggctaattggcttttgatgaattggtcatttgacacattgatttttggccaactggcacttgrtaattgatgttcgtcaaattggactgcctcccacagtgggcttggggcttgatgtctggggccaggctgtgaggcccacatgggcgcctggcaggctgag

SEQ ID NO: 111946 - DNA, 201 bp, Bos taurus; identical to SEQ ID NO: 30913

SEQ ID NO: 111947 - DNA, 201 bp, Bos taurus; identical to SEQ ID NO: 30916

SEQ ID NO: 111948 - DNA, 201 bp, Bos taurus
tgtgcccaccaggcccctcatactcttctccttgccccacagccaagaagacctgtgcagacagcgacttcacctgtaacaacggccactgcatccgagarcggtggaagtgtgatggcgaggaggactgtccagacggctctgacgagtcggaggccacgtgcagtgagtcctgcccctgggctgtggtggggcctggct

SEQ ID NO: 111949 - DNA, 201 bp, Bos taurus; identical to SEQ ID NO: 30917

SEQ ID NO: 111950 - DNA, 201 bp, Bos taurus; identical to SEQ ID NO: 30922

SEQ ID NO: 111951 - DNA, 201 bp, Bos taurus; identical to SEQ ID NO: 30923

SEQ ID NO: 111952 - DNA, 201 bp, Bos taurus; identical to SEQ ID NO: 30924

SEQ ID NO: 111953 - DNA, 201 bp, Bos taurus; identical to SEQ ID NO: 30925

SEQ ID NO: 111954 - DNA, 201 bp, Bos taurus
tgttccccaaaccaaagagacttttaagcttgtgtccagggtctgtgggaagaaatgagtgcaccagctcatgggtatgcgtaccctgactccctgagacrtgcgggaagaccagacacatggacaccaagaaaagcagggcactgacatctcacatcgaagaaacagcctctgcctctcacagtctctgcatccacaggg

SEQ ID NO: 111955 - DNA, 201 bp, Bos taurus
gaccttagtctatgcacatgtgcagcagagaccttagtgggcccaagccaactaatccttggtcaacagggtcagagcctatgcatgtgccaaggagacakgagagagtccagtggaaaataaaggaataacatttgaatcccagtccacacatcaagaaagtatagatgccttattgccttgaggtatgtgaatacaatc

SEQ ID NO: 111956 - DNA, 201 bp, Bos taurus
tcaaatatctgactacggtatcaaatcatgatcactaacttttctttttacattaatactaggacaaatcatttacctactaaaatttagaatatgtcctrtttctatcaggtatgttattaagatagttagcatgactttaaaatcctcttgtcattcatcctatggatctatttagggagacaattttgtaacgaggac

SEQ ID NO: 111957 - DNA, 201 bp, Bos taurus; identical to SEQ ID NO: 30928

SEQ ID NO: 111958 - DNA, 201 bp, Bos taurus; identical to SEQ ID NO: 30931

SEQ ID NO: 111959 - DNA, 201 bp, Bos taurus; identical to SEQ ID NO: 30932

SEQ ID NO: 111960 - DNA, 201 bp, Bos taurus; identical to SEQ ID NO: 30933

SEQ ID NO: 111961 - DNA, 201 bp, Bos taurus; identical to SEQ ID NO: 30934

SEQ ID NO: 111962 - DNA, 201 bp, Bos taurus
ttctgcatgttttcctcattgtgtttaatcatttacagcatttgattctgaagtgagagatatatgaccctttctttcacttgaacagttggaggccattktaagtttaataattgtcctaatttccatactattgtgactcagggattagggagacccaaggaaagagaaaggggaatggcctgatggtggatcagtcag

SEQ ID NO: 111963 - DNA, 201 bp, Bos taurus; identical to SEQ ID NO: 70567

SEQ ID NO: 111964 - DNA, 201 bp, Bos taurus; identical to SEQ ID NO: 30935

SEQ ID NO: 111965 - DNA, 201 bp, Bos taurus
ccttcctggcttcttttcttccttcactttttgcacgtctcctctttagctagtatttaatatcactcatgaggctaatgctgtgatgggcatctactgtrtgatatccgcttaatccattggtgtgaaagcaacaaggacttattttctcccttttgtaggaaacagcattccaactgttttttgacatctttaatttca

SEQ ID NO: 111966 - DNA, 201 bp, Bos taurus; identical to SEQ ID NO: 30936

SEQ ID NO: 111967 - DNA, 201 bp, Bos taurus; identical to SEQ ID NO: 30937

SEQ ID NO: 111968 - DNA, 201 bp, Bos taurus; identical to SEQ ID NO: 70569

SEQ ID NO: 111969 - DNA, 201 bp, Bos taurus; identical to SEQ ID NO: 70570

SEQ ID NO: 111970 - DNA, 201 bp, Bos taurus; identical to SEQ ID NO: 30939

SEQ ID NO: 111971 - DNA, 201 bp, Bos taurus; identical to SEQ ID NO: 30942

SEQ ID NO: 111972 - DNA, 201 bp, Bos taurus
ggacatgactgagcaactaagtacagcccatgaagctgtatttttaaaaacatggagatttcacatagaagtataaatttctggcctctctttaagaatcmggagacttggccaaagtggacctgcactgatgcattttcacttttggctggagctgagtagctgttgcccaccttgttgttgttcagtcactgagttgtg

SEQ ID NO: 111973 - DNA, 201 bp, Bos taurus
aacaaaatgtgttttataagtgaaggaagtcaagaacccaggaatggggtgttgggtatagtttttttgattctgtccttcatctcacggcccacattcarttaatacagatttttcttcctaatctatttcctcttctctatattgcctttttggcatctgcatttggatactaatctgcacctgaaacttaacatggcc

SEQ ID NO: 111974 - DNA, 201 bp, Bos taurus; identical to SEQ ID NO: 70577

SEQ ID NO: 111975 - DNA, 201 bp, Bos taurus
aacccttccaggtctgtctcacatgtttaatctcttgatttcacaatattcctaatgtgaggcagaaggttagagttatgaatacatttctgagctgggtkcttgtcattaaagatttctgcctcagggcccagaaatgagctatggaattacagatgaatcctggcactgtatgtgctgagcctcagagcctttccccac

SEQ ID NO: 111976 - DNA, 201 bp, Bos taurus; identical to SEQ ID NO: 70581

SEQ ID NO: 111977 - DNA, 201 bp, Bos taurus; identical to SEQ ID NO: 70582

SEQ ID NO: 111978 - DNA, 201 bp, Bos taurus; identical to SEQ ID NO: 70583

SEQ ID NO: 111979 - DNA, 201 bp, Bos taurus; identical to SEQ ID NO: 70584

SEQ ID NO: 111980 - DNA, 201 bp, Bos taurus; identical to SEQ ID NO: 70585

SEQ ID NO: 111981 - DNA, 201 bp, Bos taurus; identical to SEQ ID NO: 70586

SEQ ID NO: 111982 - DNA, 201 bp, Bos taurus
cttctctgggtcttggtatccccatctgtaaaataggaataataatagtacctaccttgtagagctccagtgaagaaaaatcacttaatatttataaatawcttagtacttggtatctgtggtgtgtgctcagtccttaagttgtgtcccactctctgccaccccatcagtgtagcccatcaggttcctctgtccatgggg

SEQ ID NO: 111983 - DNA, 201 bp, Bos taurus
aaatagaaacgctgctcactcaaagtcgtgtcctagagaggttgcatgcttatttcagtgatactattattgctttcttaatttccgttgaacaaatttayctttagtatcgacctttggaatcaattttcaggccatgtaatagaaagaactgggttttggaattagacaaaaacctcgcttcgagcctagattccccca

SEQ ID NO: 111984 - DNA, 201 bp, Bos taurus; identical to SEQ ID NO: 70587

SEQ ID NO: 111985 - DNA, 201 bp, Bos taurus
agagaagttatcctcctaggttatgaggctagcactatgacctaaggccttgtgttatgttagaaaataaagctgtattccatacctttggggcttgactraagcatctcagaaaagaaccattccctgatggcaacctggggtttctccacacctgctcctccatcccccaccctcaggagccaaactcccaggagtgaa

SEQ ID NO: 111986 - DNA, 201 bp, Bos taurus
ttttctttctctctagattatagctttggctctggcagcaagcagaggggagagatggagctgtcacctcagagcaatattctcatcaagttggttgtttycttcaatttttctaacatcttttcatcctgaaagactctgaatacttctcagcaactgactagatacatactgtttcaactgcaggaggccccacaaagc

SEQ ID NO: 111987 - DNA, 201 bp, Bos taurus; identical to SEQ ID NO: 70597

SEQ ID NO: 111988 - DNA, 201 bp, Bos taurus; identical to SEQ ID NO: 70598

SEQ ID NO: 111989 - DNA, 201 bp, Bos taurus
ccagggtgcattgttgggtctgggccctaggctgcaggccgaggaatgtggactctgcaggaatctgtttgctcatttcccagagcttgacatccctggcktgacagcacccagggagtggccctcggccctatcaccaagcagttccctgttcaggatatttgcacaggggccactctgcttagtctgtattcattagaa

SEQ ID NO: 111990 - DNA, 201 bp, Bos taurus
cagccatggcacaggccaaggtcccctcccagagggcgaagatggtcgggatggttgagacaccagcagagatataaggaaatgattttccagggactcayggccatgagtgctcacaacctggaggaagaacttggagacaagaccagacgaccccaggttctgagacagtccacagcctgtttacttggacctggagca

SEQ ID NO: 111991 - DNA, 201 bp, Bos taurus
catccactaaccattccctgagcactgactctatgcctggcctgggtggcagagatatggagacaccccaggctgatgaggtgagaaatcagtagagaacmcaaggattaggtgctgttaagagcaaaaaagacacactgatagacttcttaggggtcagaggagggacatttgggcagggccttgaaggatgagtagaag

SEQ ID NO: 111992 - DNA, 201 bp, Bos taurus
ctcttggatctcacactgctctagttgccctggccttcctgtcccttgaacaaacctacttcatttctgcctcaggatacacttgctgtatcccattcctrgaaaatgccccagataaccaaagggcttgctcttttgttcaggtccctgatcaaatatcatctgagagaggctttctatgaccagcgtatttcttcatag

SEQ ID NO: 111993 - DNA, 201 bp, Bos taurus; identical to SEQ ID NO: 70601

SEQ ID NO: 111994 - DNA, 201 bp, Bos taurus; identical to SEQ ID NO: 70602

SEQ ID NO: 111995 - DNA, 201 bp, Bos taurus; identical to SEQ ID NO: 70603

SEQ ID NO: 111996 - DNA, 201 bp, Bos taurus; identical to SEQ ID NO: 70604

SEQ ID NO: 111997 - DNA, 201 bp, Bos taurus; identical to SEQ ID NO: 70605

SEQ ID NO: 111998 - DNA, 201 bp, Bos taurus; identical to SEQ ID NO: 70606

SEQ ID NO: 111999 - DNA, 201 bp, Bos taurus; identical to SEQ ID NO: 70608

SEQ ID NO: 112000 - DNA, 201 bp, Bos taurus; identical to SEQ ID NO: 70609

SEQ ID NO: 112001 - DNA, 201 bp, Bos taurus
aaaatggaggctctggattccagatcaagctgcctgaattcaaatcctggatcttgggaaagttatttaacctctgagatccttagttttcccatgtatartgaggataatgaccgtaaatccctcgtagagttgttattgaggattaatttaatccatataaagcaccctggaatagtacttggttttgttaagtgtcca

SEQ ID NO: 112002 - DNA, 201 bp, Bos taurus
gaatggttgcaattaatgatatagccaattgcctctctttctcagagatatttgtaaggctgttttatttttgcccgggtggtcatttaggaattgagctrcttttgaataaataacaagagttggttgtgtggaagtatgagcagaggcctgactggttgtgtggaggaatgggcagaggcctgactaggctagacagtg

SEQ ID NO: 112003 - DNA, 201 bp, Bos taurus; identical to SEQ ID NO: 70616

SEQ ID NO: 112004 - DNA, 201 bp, Bos taurus
taacttttttcattttcccaaagtacttatcactttttaatatatggcactgtttactgatttattatttaaacttcttttttatttatgctgcctctccyggctaggatgaaggctggatccttttttgttcactaatatagcctaggagcccaaaactattctcggcacatagtagtcattcaacaaatagctgttaaa

SEQ ID NO: 112005 - DNA, 201 bp, Bos taurus
taaaacaaggtctaacccagaacactgttggtacccacattacagtacttaccatacagtactttaatttgggttacatgactcccttccccactggattrtgagcttctggtgggtagggttggcatcttgctcacctctcttctttcagagaaaggtatctaatgaaagtaggaaagcaatacacctggccacattagg

SEQ ID NO: 112006 - DNA, 201 bp, Bos taurus; identical to SEQ ID NO: 70617

SEQ ID NO: 112007 - DNA, 201 bp, Bos taurus; identical to SEQ ID NO: 70618

SEQ ID NO: 112008 - DNA, 201 bp, Bos taurus; identical to SEQ ID NO: 30945

SEQ ID NO: 112009 - DNA, 201 bp, Bos taurus; identical to SEQ ID NO: 30946

SEQ ID NO: 112010 - DNA, 201 bp, Bos taurus; identical to SEQ ID NO: 30947

SEQ ID NO: 112011 - DNA, 201 bp, Bos taurus; identical to SEQ ID NO: 30948

SEQ ID NO: 112012 - DNA, 201 bp, Bos taurus; identical to SEQ ID NO: 30949

SEQ ID NO: 112013 - DNA, 201 bp, Bos taurus; identical to SEQ ID NO: 30950

SEQ ID NO: 112014 - DNA, 201 bp, Bos taurus; identical to SEQ ID NO: 70625

SEQ ID NO: 112015 - DNA, 201 bp, Bos taurus; identical to SEQ ID NO: 30951

SEQ ID NO: 112016 - DNA, 201 bp, Bos taurus
tccttacctggaaacttctccctggaacagataaaaacctttcccatgtgtctgtattttgttctgaagataaccttggattagaaaggccttttcagtaygaggcaggaaagctggagcttgtaccttgacctctgaggtaaatctaatgaagccaagccaattccccaggctaaagaccaagttgactcaaatggttta

SEQ ID NO: 112017 - DNA, 201 bp, Bos taurus; identical to SEQ ID NO: 70627

SEQ ID NO: 112018 - DNA, 201 bp, Bos taurus; identical to SEQ ID NO: 30958

SEQ ID NO: 112019 - DNA, 201 bp, Bos taurus
ggaaacatggagtcttaactattgtacctccagggaagtcctatactagaggtttcaattagagctgaaagtaaagcttctgaggcttaacaatttatggraatggctatatatcttttcagtagttaaaactactaagtagtttcttaagacacatgttctgagtgccaccgaagtgccaatatttatactgtctaaatt

SEQ ID NO: 112020 - DNA, 201 bp, Bos taurus
tgggtactggggtctctactcagagcttggcagtacaagctggtacagaattaggtagttccagaagctagcagcaaccagcccagaggcggtttctatayggggacaaccctaacagggccgaactgtgtaagaagtggtgtttgttggtcttgttaaagagctcttctccacaggcatcagggaactgggctccacagg

SEQ ID NO: 112021 - DNA, 201 bp, Bos taurus; identical to SEQ ID NO: 30967

SEQ ID NO: 112022 - DNA, 201 bp, Bos taurus; identical to SEQ ID NO: 30968

SEQ ID NO: 112023 - DNA, 201 bp, Bos taurus; identical to SEQ ID NO: 30969

SEQ ID NO: 112024 - DNA, 201 bp, Bos taurus; identical to SEQ ID NO: 30970

SEQ ID NO: 112025 - DNA, 201 bp, Bos taurus; identical to SEQ ID NO: 30974

SEQ ID NO: 112026 - DNA, 201 bp, Bos taurus; identical to SEQ ID NO: 30975

SEQ ID NO: 112027 - DNA, 201 bp, Bos taurus; identical to SEQ ID NO: 30976

SEQ ID NO: 112028 - DNA, 201 bp, Bos taurus
tccctttatctttaacctatatgtgtctttatatttaaagttggttttttttaaacaacatgaagttgggtctcatttcttgatccactttgagaatctckttcttttaactgatgtacttagatcagttcagttcagttgctcagttgtgtctgactctttgcaaccccatgaattgcagcacaccaggcctccctgtcc

SEQ ID NO: 112029 - DNA, 201 bp, Bos taurus
catatttgttccaagtcccttgaaactgagcacagatggaaccatgcaaacttagtgacagagtcttggccccaaatggccttcactgggcactgcacacycctttagtgttggacctgactcagccacactcctgctgggtcccaggacaggactctcctcttctaggagcactgctctcctctctacctgccgtggtct

SEQ ID NO: 112030 - DNA, 201 bp, Bos taurus; identical to SEQ ID NO: 30979

SEQ ID NO: 112031 - DNA, 201 bp, Bos taurus; identical to SEQ ID NO: 30982

SEQ ID NO: 112032 - DNA, 201 bp, Bos taurus; identical to SEQ ID NO: 30983

SEQ ID NO: 112033 - DNA, 201 bp, Bos taurus; identical to SEQ ID NO: 30984

SEQ ID NO: 112034 - DNA, 201 bp, Bos taurus; identical to SEQ ID NO: 30985

SEQ ID NO: 112035 - DNA, 201 bp, Bos taurus
tttttggcctcgctgtaagacatgcaggatcctagttcctcaaccagggattggatccatgcccctcctccccacaacagcagtttgaagtcttaaccacyggaatgtcagggaaggcctaatcctagactattttagattcctggaattcagtcttccccagggtagctacgtcatctgccttcatggttaccactctgg

SEQ ID NO: 112036 - DNA, 201 bp, Bos taurus; identical to SEQ ID NO: 30987

SEQ ID NO: 112037 - DNA, 201 bp, Bos taurus; identical to SEQ ID NO: 30988

SEQ ID NO: 112038 - DNA, 201 bp, Bos taurus; identical to SEQ ID NO: 30991

SEQ ID NO: 112039 - DNA, 201 bp, Bos taurus; identical to SEQ ID NO: 30992

SEQ ID NO: 112040 - DNA, 201 bp, Bos taurus
cgggagttggtgatggacagggaggcctggcgtgctgcgattcatggggtcgcaaagagtcggacacgactgagcgactgaactgaactgatacaagggasacagagcaacccgaccctcttatacaattgctgagttcaaggaacctcagtgtgctgcataagtaattggaatgtacacccacctgcatttcttctaccc

SEQ ID NO: 112041 - DNA, 201 bp, Bos taurus
agtatttaataaacacttgaaagctggaaagctaattttgtcagattctgatttttcaagaacttatcttctaggaaaaccataaatcctaacaggtactrtaaaacaggcttggacaaaaccaagagataagaaattctactattagtatctgcatatgtaacctcaaagagtcagttgatctctgtgtttcagcttcct

SEQ ID NO: 112042 - DNA, 201 bp, Bos taurus
aggtcaagtccaatgaggactggtctggggagttaggtcatggtgatgggttaggtcagggatgagaacagcccctgatcctattaatcaggcagggagargggcctgccagtcagtgtaggctggtgcaggtaattgggtatccaccacatactcctctgctaagatcacaatttccatgacacagccgctctctaatgg

SEQ ID NO: 112043 - DNA, 201 bp, Bos taurus
cctttgccctcctctgaaccatccccctggccccctggaagttggctttattctcatgtcacagccgaggaagacaggtcaggagaggagaggcaagtgaycttcctaggaccctgcactcagaaagcggcaggcctggaagctgggcccacgctctctgacaaagagactgacatgctgcctactgcgctcagagggcag

SEQ ID NO: 112044 - DNA, 201 bp, Bos taurus; identical to SEQ ID NO: 30993

SEQ ID NO: 112045 - DNA, 201 bp, Bos taurus
atttgctttttctaatttgtcctaatgagcccacattttttctttatcagacccattttctctggcaaaaggtcatcacgggcaatcatgcatgtctgctyggtataaattgttttcataacaattttcatttgccttggaaagtgcgccacgctgaaaacatggccactttatatctgtgacagcacgcatcatatttcc

SEQ ID NO: 112046 - DNA, 201 bp, Bos taurus; identical to SEQ ID NO: 30994

SEQ ID NO: 112047 - DNA, 201 bp, Bos taurus; identical to SEQ ID NO: 30995

SEQ ID NO: 112048 - DNA, 201 bp, Bos taurus
gttcctacctccctccattccagcctcttgattgggttgcagggcagaggcaaaaactgctgagcagtgttcttggtcaacggattatttattggcagaartgaaagtcccttatcttcccaagcaggagaatgccttaatgctacttttaccttttagattatgcacaggttcaatccaattaattgcagaatgtgaatt

SEQ ID NO: 112049 - DNA, 201 bp, Bos taurus; identical to SEQ ID NO: 30997

SEQ ID NO: 112050 - DNA, 201 bp, Bos taurus; identical to SEQ ID NO: 30998

SEQ ID NO: 112051 - DNA, 201 bp, Bos taurus
ctgaggttccaacaggcaagaaaacgtcaaagcccttggcctgttttcgggactcatgaagctgaagcctcttgggttcatcagaggggcagccaatcttmccccttagaatcctcgggcctcaaagacagccttcagtttaagagcagctccggacccctaggcttcccaggtggcactagctagcggtaaggaacccac

SEQ ID NO: 112052 - DNA, 201 bp, Bos taurus
cgatgtctctcctcaggaggagagagaatggggcctcagcacaggcgctgcatatgaacacggtcacacccttgacaacgcgcgttggcctcctttttccycacacagccccatgaggcaggcaggatgggctggtcccgtcacacacccctgctgaggctaagggaggaaatgcggccgtgggtggcagtgtccgcggca

SEQ ID NO: 112053 - DNA, 201 bp, Bos taurus
agactcttccaggtacttcaggctcattatgaagatgaaaagggccactgcttgagaaagtacctggtgagttcctgggcctttagtcctttgtctctgaktgtttgttttcttcctctttgagggtcctgcagtttagctagaaaggtaggccttacacagcttcaccaatctgagaatgtgcccatctcgcacgttacc

SEQ ID NO: 112054 - DNA, 201 bp, Bos taurus; identical to SEQ ID NO: 31001

SEQ ID NO: 112055 - DNA, 201 bp, Bos taurus; identical to SEQ ID NO: 31002

SEQ ID NO: 112056 - DNA, 201 bp, Bos taurus; identical to SEQ ID NO: 70665

SEQ ID NO: 112057 - DNA, 201 bp, Bos taurus
atagtgtcggtggggcccttccagctggcggtcctgaggacctgcttgagaagggctgcctctgggagatgcacaagcttctggaggagatctgcatgtcmctgagccctggccacaggctccttggctggaagaacgctctgggagtgtatccatcccaatctttcgacaagttcatgaagtcattagatataaagtcgg

SEQ ID NO: 112058 - DNA, 201 bp, Bos taurus; identical to SEQ ID NO: 70667

SEQ ID NO: 112059 - DNA, 201 bp, Bos taurus
tcaaaaactacaattgaaaactattaataacaaaaaagcaaacagctctattcaaaagtgagcagaagacctaatagacatttttcccaaagaatacacayagatggccaataggcacatgaaaagatgctcatcgttgctaattagagaagtgcacatcaaaactacaatgaggtaccaccttacaccaatcagaatggt

SEQ ID NO: 112060 - DNA, 201 bp, Bos taurus
ctatgagagctcggcctccctttttggccatgtaccggaaattgcatagacaggctgatggaaagtgtggtggggagtgctttccggaaggaatctggtgrgcaggcttgggcccaggctcctattctcttttcacttttttttgcctacccctgcactgtaagtaggattgaccatggtgatttggaggaagacatagag

SEQ ID NO: 112061 - DNA, 201 bp, Bos taurus; identical to SEQ ID NO: 70669

SEQ ID NO: 112062 - DNA, 201 bp, Bos taurus; identical to SEQ ID NO: 70670

SEQ ID NO: 112063 - DNA, 201 bp, Bos taurus; identical to SEQ ID NO: 70672

SEQ ID NO: 112064 - DNA, 201 bp, Bos taurus; identical to SEQ ID NO: 70673

SEQ ID NO: 112065 - DNA, 201 bp, Bos taurus; identical to SEQ ID NO: 70674

SEQ ID NO: 112066 - DNA, 201 bp, Bos taurus
ctgttggtttctaacagggaacaaaccaaaatccaagttatatcgctctgccctccctaccccagcccccaccccacacaccaacaataaatgagaaacaygtagctaaagcccaacatggtgtgttctgctcaagagctgggcctgaccccaggccagctgcctctgtctggtggaacgccaggatgctcttcggcagtt

SEQ ID NO: 112067 - DNA, 201 bp, Bos taurus
ggggagggcctgaagggggctgagctcaccaggctgcggccccgagcggcgaagtcttctccgagcgcgatgctccgggagcctggggccgctgctcacgycgcgtagcccactccaggctccgggctgctgcagctccacccccacccccgcagcgctctcgaccaatccgcggcggcctcactccaggctccagccaat

SEQ ID NO: 112068 - DNA, 201 bp, Bos taurus
aactccaaggagagtttgtttttgattagaatggtctttgggaaaaatggaaacgttccagttaagggaaaggagtcagaatatagacacaaagcctattrattcttctttagcagtagtttagttccagcaaatcacctaaaccatgacatttaacaaactgtgctcttaacaaagctaggcacacagcaaaggcaatga

SEQ ID NO: 112069 - DNA, 201 bp, Bos taurus
tttcccctggtaggattttttttagggacagtggtagtttttgtttaaatatagttgtgtctgaactaaaaatgtgttgcgggctgaatttttgtgaatcrgtctttaatatttagcagacgttagtgtaacatgtgtcttatgaaggagagctcctacctggactgtggtgacactacctggataagtatcaacaggcca

SEQ ID NO: 112070 - DNA, 201 bp, Bos taurus
tttttctgacttatttaaacagtgtctaatgaccaccctgcaaaattagttcatattcctcaaatgatcctgtcataattttttgttgttaaacactgaaytataacctctgagatacttcagaaatactgagaaggtaaaaataaatatacttgaatctaattaaagttaatatgaaaagtattaaatgaattccaacta

SEQ ID NO: 112071 - DNA, 201 bp, Bos taurus
gatctaaagttttctaaacctaagactatcaacgataaacttcaattgctcagtatactacagtgaaatgcaaataagaactgataaagtgatagatgttrataaatatttgataacacaagtacagtaaaatgtcaatgacagaatctaaatgttggtcattatggacacatcctgcattttttttttcagttttgctga

SEQ ID NO: 112072 - DNA, 201 bp, Bos taurus
tatataggactgcaggataacaactgcattgttgtgtactgtggaatggggagggcactcttggaggaggactgctgaaggtggtcagtctacctgagaayggaagacatacttggtggggagcagggtatgtgcttttatatgaaaagagccgatgttaaaactcatttggttaggtaaacgttgtcacataccttcaca

SEQ ID NO: 112073 - DNA, 201 bp, Bos taurus; identical to SEQ ID NO: 70681

SEQ ID NO: 112074 - DNA, 201 bp, Bos taurus; identical to SEQ ID NO: 70683

SEQ ID NO: 112075 - DNA, 201 bp, Bos taurus; identical to SEQ ID NO: 70684

SEQ ID NO: 112076 - DNA, 201 bp, Bos taurus
ccaacccttcaccagaaatcttcagagatgtctgggcctctgaggtctgacccagatgccataggacttggtgagtgacaggaatttcttttccctctctygggctcccctgccctggccttgcttgctttcctgggatcatcgttttttcccagccatggccaacagcatgcatgagctgggtggggggaccctacctaa

SEQ ID NO: 112077 - DNA, 201 bp, Bos taurus
ttgttgcatgttgcttggaatgaaaggccattagatagggggctagaaattcccttggttgtacagagatttcttgtttccagagggcctgacctagcagrctttctggcaatcctattgaaccctgtctgtctgaagctagccctcaaggagcaggggagggtgcctggggaggagggtcaacagggaacatcagagagc

SEQ ID NO: 112078 - DNA, 201 bp, Bos taurus
tcagaattcagaaaggggaagctcagagaaaaagaagagaaggagttttcctccccctgactcctcatttaaagggaaaattccctccaatggaggtgggygggttaagaaactccacagcctctcctgcttcattgtgaatcagtcgtgttcaactcttttgaactcaacattcaaaaaatgaagatcatggtatcctgt

SEQ ID NO: 112079 - DNA, 201 bp, Bos taurus; identical to SEQ ID NO: 70689

SEQ ID NO: 112080 - DNA, 201 bp, Bos taurus; identical to SEQ ID NO: 31006

SEQ ID NO: 112081 - DNA, 201 bp, Bos taurus; identical to SEQ ID NO: 31007

SEQ ID NO: 112082 - DNA, 201 bp, Bos taurus; identical to SEQ ID NO: 31010

SEQ ID NO: 112083 - DNA, 201 bp, Bos taurus
gagtcgattatagtgcttaagactgtggcctctggaatcaacctgccaggttttaagaactaattctaccactgatgaggtttatgaccttcagtaagttmctttgccttactaggcctcatttgtgtcatcaggaaggtggagataaaaaataaataaaaacggtacctacttcataaggttgtcttaaggaacagatgg

SEQ ID NO: 112084 - DNA, 201 bp, Bos taurus; identical to SEQ ID NO: 31011

SEQ ID NO: 112085 - DNA, 201 bp, Bos taurus; identical to SEQ ID NO: 70695

SEQ ID NO: 112086 - DNA, 201 bp, Bos taurus
cctggtggggcgggtggtgcaggcatcgtgggtctgcactgcgcggcgtggaagcagcggcctgtctttgaagagcatgttgaagtagcatccacgcgtgsacttgggtctgaaaagaatcctcggacgcaacctggcagtcctcccgtagcgcaggccggtttctgcccgaagctcctcggtcaggaggctttctctacg

SEQ ID NO: 112087 - DNA, 201 bp, Bos taurus; identical to SEQ ID NO: 70699

SEQ ID NO: 112088 - DNA, 201 bp, Bos taurus; identical to SEQ ID NO: 70703

SEQ ID NO: 112089 - DNA, 201 bp, Bos taurus; identical to SEQ ID NO: 31015

SEQ ID NO: 112090 - DNA, 201 bp, Bos taurus
tcgagggtcatgtttctctgttggtcagtggcccgccctggagtgaggctgggtgggggggacgcgtgcctctggggacatcacgcatccatggcactggkcagcgagtggtcatccggccttcaggagcacagagacatccacctctagtccaggtgcttccaaaatgtcactgctttgcttaaaattctggcagtattt

SEQ ID NO: 112091 - DNA, 201 bp, Bos taurus
aggccgtgtgcacatcaacatcgtgagtaaaagcaactgctccgttgacgctaatgacagagagcttgaatgatgctcggagtccacttgggggagctgcmcggtgcttccaggtcggccggcctggcagaggttttcgcgtggttcctgtccgtggtctctgtgcaggacaagtccttgtttcggtgcagctcatgacaa

SEQ ID NO: 112092 - DNA, 201 bp, Bos taurus
gtcagctcttctgctctcttcacctcctgggggcaataggacccagtccaaagtctggttccttctcttcacttcgggcctcagcttgactctctccctgrgctctgggctgagaattagcatcctctctcccctcacccaagggtgggtgcccatagcaaggccacccttctctccaaagagacctctccccagtctcct

SEQ ID NO: 112093 - DNA, 201 bp, Bos taurus; identical to SEQ ID NO: 70707

SEQ ID NO: 112094 - DNA, 201 bp, Bos taurus; identical to SEQ ID NO: 70708

SEQ ID NO: 112095 - DNA, 201 bp, Bos taurus; identical to SEQ ID NO: 70709

SEQ ID NO: 112096 - DNA, 201 bp, Bos taurus; identical to SEQ ID NO: 70710

SEQ ID NO: 112097 - DNA, 201 bp, Bos taurus; identical to SEQ ID NO: 31019

SEQ ID NO: 112098 - DNA, 201 bp, Bos taurus
gagggactgaacaacaacaaaaaatatacgtgtgtatgcgtgtgtatgttagatatagattcagatatatgatatgtgtggagattttccaaaaatacacrcaggaacacaagaaactattacagtggttatctctaaccatggagtagagcatgtgagacagaacagactcacatttcattgcattctttctgtgctatt

SEQ ID NO: 112099 - DNA, 201 bp, Bos taurus
agtactgatgaaacatagcagggaatagtgtgttaggaagccccatctgtctcaccatgcacagatgtgcacacagcctcatcctctggcctccttgctgrtggacctgggtgcccagctcaaagtgtggatgccttctctgtgtctgcagagccacatctggtgcattagggccagctctctcctctctgcaaagactga

SEQ ID NO: 112100 - DNA, 201 bp, Bos taurus
tagctagttctgtttggcaaggcgccttttctaaaattcatactgtcatgtatgtctttgatcactggatgctgagaaaattgcacacctttgtgccctgkgacagcaggtccaccacgaaaggaccatccctctgagacctgggcaggatatggctgaatttcccacttggtttccatggaaggaagcccaggagaggct

SEQ ID NO: 112101 - DNA, 201 bp, Bos taurus; identical to SEQ ID NO: 70717

SEQ ID NO: 112102 - DNA, 201 bp, Bos taurus; identical to SEQ ID NO: 70718

SEQ ID NO: 112103 - DNA, 201 bp, Bos taurus; identical to SEQ ID NO: 31025

SEQ ID NO: 112104 - DNA, 201 bp, Bos taurus; identical to SEQ ID NO: 70720

SEQ ID NO: 112105 - DNA, 201 bp, Bos taurus; identical to SEQ ID NO: 70722

SEQ ID NO: 112106 - DNA, 201 bp, Bos taurus
ggttctctttgactccttagttcctcgtgggcctacagaatgatcgtagccgtgaccccgccatgagctcaggtcttgctcgtgtgcaggagccgtggccrcgctgagcctgatgtccctgtgggtgtgctttggggcgtccggggtggcatgtgccctctagatgcatagacttgtcatctgagatgacgtccctcccag

SEQ ID NO: 112107 - DNA, 201 bp, Bos taurus
ttgttggtgtggaggaaactcacacgtttggtgtcagaactgttgtagatggagaatgtctcagtcagtgatgccgaagggcccggagcagaaggagccayagactctgaaatctgcacagcaggtttgtgcgccttgtctgacccccgggtactgtgaaactctcccatcagggccgcgggcccctgggggtgactcact

SEQ ID NO: 112108 - DNA, 201 bp, Bos taurus; identical to SEQ ID NO: 31028

SEQ ID NO: 112109 - DNA, 201 bp, Bos taurus
gcttggttccagtcccatggactagggggcttaaaaagagtcattcattttctcacagtcctgaagcctggagagccaaggtcaaggtgatgccttcctcygaggcctctctccctggtttgtggctggccctcttctcccgtatcttcacaccagtttcagtctgtgtatctccgtgtcccagtctcctcccgttagggc

SEQ ID NO: 112110 - DNA, 201 bp, Bos taurus; identical to SEQ ID NO: 70726

SEQ ID NO: 112111 - DNA, 201 bp, Bos taurus; identical to SEQ ID NO: 70728

SEQ ID NO: 112112 - DNA, 201 bp, Bos taurus; identical to SEQ ID NO: 31030

SEQ ID NO: 112113 - DNA, 201 bp, Bos taurus; identical to SEQ ID NO: 70729

SEQ ID NO: 112114 - DNA, 201 bp, Bos taurus; identical to SEQ ID NO: 70730

SEQ ID NO: 112115 - DNA, 201 bp, Bos taurus
agcgaaaaagagtggaggtatacggcctggctgggaggaggtgggagtaacagagggcgtaaatggggagaggggggcctgcctggctggccgggaagggygttccaggtctgtgactggaaactgctcacatgctgaaggcagtgttggggaaccccggttgggtacctgaatgtggggccgtccgtgtcctgcaggggg

SEQ ID NO: 112116 - DNA, 201 bp, Bos taurus; identical to SEQ ID NO: 70731

SEQ ID NO: 112117 - DNA, 201 bp, Bos taurus; identical to SEQ ID NO: 31032

SEQ ID NO: 112118 - DNA, 201 bp, Bos taurus
agggtatctctgtcatgagcctagaccccgaatgtgacatcttctctaaggctctgtccacaccagaaggctgggacccccgtcacatcctgggtccccayggcctccctgggatgatgccttggctctgctatgagatgaggtgtctgggcgatcaaggccactgtatccatgatacagacatggatagtggcagcagcc

SEQ ID NO: 112119 - DNA, 201 bp, Bos taurus; identical to SEQ ID NO: 70733

SEQ ID NO: 112120 - DNA, 201 bp, Bos taurus; identical to SEQ ID NO: 31034

SEQ ID NO: 112121 - DNA, 201 bp, Bos taurus; identical to SEQ ID NO: 31038

SEQ ID NO: 112122 - DNA, 201 bp, Bos taurus; identical to SEQ ID NO: 31039

SEQ ID NO: 112123 - DNA, 201 bp, Bos taurus
ttaagaatccacttgtcactgcaggggacacgggttcaatctccgatctgggaatcatctacatgcagccgagcaactcaacccttgccccaccaataccragccagtgatccagggcccgcaaaccacagctactgagcccatgcaccacacctactgaggctcgcacacctagagccagcgctccacaagaggagccac

SEQ ID NO: 112124 - DNA, 201 bp, Bos taurus
tcagaccccagcgtgaggcctggcgcagggaaaggacctctctgctgggcactcacgggtgactccccaaatgcccttctgcaggcactctgcttcctggrggcctccttataaatacaccgtatcctgagagtaccccagggaccctgagtcccttgggctgggccagagaaagctggtttgttatttaaaagatgttcc

SEQ ID NO: 112125 - DNA, 201 bp, Bos taurus; identical to SEQ ID NO: 31044

SEQ ID NO: 112126 - DNA, 201 bp, Bos taurus
gggcccgcggatggttgaatggcctgtgtcgaattctctggggaattcttccttcatcccagtgccctggtggaggacacagccacaggtgtgcacagtcytcatggtgggcatgtggcccagcaggccaatcagagtattctccgggatggatgtgtgatgcaggccgagaggtttctcttgcagccactgagtgaggag

SEQ ID NO: 112127 - DNA, 201 bp, Bos taurus; identical to SEQ ID NO: 70741

SEQ ID NO: 112128 - DNA, 201 bp, Bos taurus; identical to SEQ ID NO: 31047

SEQ ID NO: 112129 - DNA, 201 bp, Bos taurus
gtggccgaagtattggagattcagcttcagcatcagtccttccaatgaacattcagaactgatctactttaggattgattggtttgttctccttgctgtcygagggactctgaagagtcccaggcctctgggcacaagttttcgagacgtgaatggcattggcctgcctctgtgacccctcaggacggcagacgtccagtc

SEQ ID NO: 112130 - DNA, 201 bp, Bos taurus; identical to SEQ ID NO: 31048

SEQ ID NO: 112131 - DNA, 201 bp, Bos taurus; identical to SEQ ID NO: 31052

SEQ ID NO: 112132 - DNA, 201 bp, Bos taurus; identical to SEQ ID NO: 70750

SEQ ID NO: 112133 - DNA, 201 bp, Bos taurus; identical to SEQ ID NO: 31057

SEQ ID NO: 112134 - DNA, 201 bp, Bos taurus; identical to SEQ ID NO: 31058

SEQ ID NO: 112135 - DNA, 201 bp, Bos taurus; identical to SEQ ID NO: 31060

SEQ ID NO: 112136 - DNA, 201 bp, Bos taurus; identical to SEQ ID NO: 31062

SEQ ID NO: 112137 - DNA, 201 bp, Bos taurus
ggttcacggctggggagcagcagctccatgaggctgctaggaaggctgttttggtggcccctaatagctccaccccgttagccttgggccatttctgcccygagtgatgcgagcccgtgagttgcttctaaatgagaaaggacagtgcaaggaatgggatggcccttccaagatgaagcgagaaggactctggctcctgtc

SEQ ID NO: 112138 - DNA, 201 bp, Bos taurus; identical to SEQ ID NO: 31063

SEQ ID NO: 112139 - DNA, 201 bp, Bos taurus; identical to SEQ ID NO: 31064

SEQ ID NO: 112140 - DNA, 201 bp, Bos taurus; identical to SEQ ID NO: 31065

SEQ ID NO: 112141 - DNA, 201 bp, Bos taurus; identical to SEQ ID NO: 31066

SEQ ID NO: 112142 - DNA, 201 bp, Bos taurus; identical to SEQ ID NO: 31067

SEQ ID NO: 112143 - DNA, 201 bp, Bos taurus; identical to SEQ ID NO: 31068

SEQ ID NO: 112144 - DNA, 201 bp, Bos taurus; identical to SEQ ID NO: 31069

SEQ ID NO: 112145 - DNA, 201 bp, Bos taurus; identical to SEQ ID NO: 70761

SEQ ID NO: 112146 - DNA, 201 bp, Bos taurus; identical to SEQ ID NO: 70762

SEQ ID NO: 112147 - DNA, 201 bp, Bos taurus
aaaaaccaaaactattttggggagggggatactaaataattattataagttatttcttcaaaattgacaaaccacccagggaagatagctaggaaaacgtygaggatggaaaaatattgacagacggagagaaagagaaagggggatatatattgagaatttaaatcatgacagaaccttactaacaactactgatgctaa

SEQ ID NO: 112148 - DNA, 201 bp, Bos taurus
tggctacccactttagtattcttgtctggagaatcctctggacagatgagaccagtaggctacagtctatggggggtgacaaacagctgaacatgactgcrtgactaaacacacacactggttgcatagttcaattatatcagagtgctataacataaactcagacatatttgtttcaaaagcttatattcttaaccatta

SEQ ID NO: 112149 - DNA, 201 bp, Bos taurus
tattgttgcctggataatcccatggtcagaaaaccctggccgactacagtccatagggttgcaaagaattggagataactaaagtgaccgagcactcacgyacacacatgaacttgttctggggccaattgaatatgaatattgcattatttttattttgggcatttaaagttttcagttagcgactattgattgtgtcta

SEQ ID NO: 112150 - DNA, 201 bp, Bos taurus
aaggaaataagtgatggagccacacccttttaggtatatggctgcaaacttagtgttaataagtaggaaacatgcagctcaatacttgggcaggccccttycttaatccacgtcagatcgtccagaagcctctccccctggagtctctggtgcacgcgtcttgaggggccacgccccttcaggaataaaaaaaaaaaaaaa

SEQ ID NO: 112151 - DNA, 201 bp, Bos taurus; identical to SEQ ID NO: 70767

SEQ ID NO: 112152 - DNA, 201 bp, Bos taurus
aattaattctccccaaaggcaatcataagaaggcaatatataatgctttttttggtagacaaaataagtatctgtttgtgcagatggccagtgaaaaatamactctttcagtccagagactctcactgtgggatctcaaggcaaccatgtcacaattcaattaagggcctggaaatgcagatttaaaccaacaggctacgg

SEQ ID NO: 112153 - DNA, 201 bp, Bos taurus; identical to SEQ ID NO: 70769

SEQ ID NO: 112154 - DNA, 201 bp, Bos taurus; identical to SEQ ID NO: 31071

SEQ ID NO: 112155 - DNA, 201 bp, Bos taurus
atgtgcttcagaacagctacttttcccacactccatccccaccctcaccctgcccccagcaaaaggatgaagggagttttcttggcctcttacttggaaarcctgattgagttcctgagataaaacctcaccaaattgtggaggctctcctcacactgggcctctgggttttcagcccaaactttcccatgcagccctcca

SEQ ID NO: 112156 - DNA, 201 bp, Bos taurus; identical to SEQ ID NO: 70778

SEQ ID NO: 112157 - DNA, 201 bp, Bos taurus; identical to SEQ ID NO: 31075

SEQ ID NO: 112158 - DNA, 201 bp, Bos taurus; identical to SEQ ID NO: 31079

SEQ ID NO: 112159 - DNA, 201 bp, Bos taurus; identical to SEQ ID NO: 70783

SEQ ID NO: 112160 - DNA, 201 bp, Bos taurus; identical to SEQ ID NO: 70784

SEQ ID NO: 112161 - DNA, 201 bp, Bos taurus
gctcgcattcatgagctgtatacatttagaggcgcacaggaaatgaagtgtgaaagagagtaattgagccactgtaaaatcagattagaaaaatgtaccayctttgccttacctctcttttttcctctctcccaagcgtctcactcatataatcctctatattgaccgctacagcatctatccatgatattaaggagctgc

SEQ ID NO: 112162 - DNA, 201 bp, Bos taurus
attttctatgtttttcactttcccataaaagtaaacaatttggtattttccatctttttataaatttgtgcatcaagagtagtttcctctcttttatctaytgttctccagttctctaaccatgtctgattcactacaggatccatttatgttctctgttttattttccagttctgaaactacattttcctcaatttttga

SEQ ID NO: 112163 - DNA, 201 bp, Bos taurus; identical to SEQ ID NO: 31082

SEQ ID NO: 112164 - DNA, 201 bp, Bos taurus; identical to SEQ ID NO: 31083

SEQ ID NO: 112165 - DNA, 201 bp, Bos taurus; identical to SEQ ID NO: 31084

SEQ ID NO: 112166 - DNA, 201 bp, Bos taurus; identical to SEQ ID NO: 31085

SEQ ID NO: 112167 - DNA, 201 bp, Bos taurus; identical to SEQ ID NO: 31086

SEQ ID NO: 112168 - DNA, 201 bp, Bos taurus
aggctcactttggcctgaaaacacagatcccaagggaagctccacagcctggagattgccagccacacagcccagagaacccccatgcctccgtcttgtarcgatgctgggccccagtctctcctccaagtggaacttctctggatgctcaagcaaggtggacataaagggtgaggaaagatgggaccgtgtagctaaact

SEQ ID NO: 112169 - DNA, 201 bp, Bos taurus
tcagccagcattgactgcatccctgctgtgcacagtgaggccccagggatccacaaggagacaggactcatcgtctggcctcgaagctggaaaagactacrtggagagcatcccaaagcatggtgagagctctccggggatgcaggaaaggcccaggggagatccacagggctgaactggagcagcagatcagcagcagat

SEQ ID NO: 112170 - DNA, 201 bp, Bos taurus
gagagagaggctatggtgatgcttccaccccactacgtgtgactcagcagtattgccttgtttccatggctgcctggatttccttcatagttatttcccaycacaatctcttccctcacatcccatagatccatctctccacagccaacagcggccctcgcccagggattgctccacaatccctaaactccaggtcccaga

SEQ ID NO: 112171 - DNA, 201 bp, Bos taurus
tggttaaggtttaaaaagaaaaagaagaaggatctggtgttagcacagtacaaattgagagtttcttaaaagcagttgggtacataattgaaaactaattkaatgttctaatccatatgcatgaaaaacaatttgcattgcttcattacttaaaagcagtgtgaagatgaggatgtgctgggaatctacaggaggagcagt

SEQ ID NO: 112172 - DNA, 201 bp, Bos taurus; identical to SEQ ID NO: 70793

SEQ ID NO: 112173 - DNA, 201 bp, Bos taurus; identical to SEQ ID NO: 31087

SEQ ID NO: 112174 - DNA, 201 bp, Bos taurus; identical to SEQ ID NO: 31088

SEQ ID NO: 112175 - DNA, 201 bp, Bos taurus; identical to SEQ ID NO: 31089

SEQ ID NO: 112176 - DNA, 201 bp, Bos taurus; identical to SEQ ID NO: 70797

SEQ ID NO: 112177 - DNA, 201 bp, Bos taurus
tgacaatctgcaaacatggatgctacctatcaatctgtctatgtagtggaaagaaaatgagactatgtatcaagaagatttagggcctacagaagccccaktcacagcaaggaaacctaaattttcaaattaccgtaaatccaggggaagtcaggcctaggcagttaaaaaacaatgcagaggccaggcctcccagcagct

SEQ ID NO: 112178 - DNA, 201 bp, Bos taurus
tgtcaacattggcctgttatgattactgtaatcacatagaggcttttctactgggtggagtaagtcaggatcctgagtcttcctcctgaccaggcaccacygtgggcttggcctgctcgttccaggtttagcaggaatcctgatgagtcaatttagtgagaattccccacccttggtgttagggactgtttacatcaccca

SEQ ID NO: 112179 - DNA, 201 bp, Bos taurus
catggggttgcaaagagtgggacatgactgagtgactgaacaacaactggcctttgaaaaaatcaaacttaaaaggcagattccggggccacgagacacasacagctgacaagcaacgccatgctatctatctggtgctcctgtcaccttttttttctccttttcaagttcctcggcctctctttgccaaatcgtcttcat

SEQ ID NO: 112180 - DNA, 201 bp, Bos taurus
ctagcagtgtgtggtggtcccagttttcccacatcctcaccaacacttgccattcttttttcacaactgtagccatcctggtagatgtgaagtgctgtctyactgggattttgtattttttattctgtactttatatttccctaatgactgctatctcgagaaggacatagcaacccactccagtattcttgccagggaaa

SEQ ID NO: 112181 - DNA, 201 bp, Bos taurus
aggttgccaggaaaagtggtcctaataggtaagcacctcaaaatttccaggacctggaatgagcttttagtttttggcctcccagtgatagcattcacaarcacccctcactgaacccatggctctgatgggacattggatgccagagctgttgcactagaagtgtgaagccatttcaggctggccatcgccatagctgat

SEQ ID NO: 112182 - DNA, 201 bp, Bos taurus
attttaccatatgtttgcttcagatttttttttaagtaataaagtaccagtgaatgtttctccaattccattctttacctgcacctcccagaagtaaccarcaacctaaaatttttatattaacccataaatgtttatatagtactttagcatgtaaatttttaataccagttttgtacttatataaaaagataaatttat

SEQ ID NO: 112183 - DNA, 201 bp, Bos taurus; identical to SEQ ID NO: 70798

SEQ ID NO: 112184 - DNA, 201 bp, Bos taurus; identical to SEQ ID NO: 70800

SEQ ID NO: 112185 - DNA, 201 bp, Bos taurus; identical to SEQ ID NO: 70801

SEQ ID NO: 112186 - DNA, 201 bp, Bos taurus; identical to SEQ ID NO: 31091

SEQ ID NO: 112187 - DNA, 201 bp, Bos taurus; identical to SEQ ID NO: 31094

SEQ ID NO: 112188 - DNA, 201 bp, Bos taurus; identical to SEQ ID NO: 31095

SEQ ID NO: 112189 - DNA, 201 bp, Bos taurus; identical to SEQ ID NO: 31097

SEQ ID NO: 112190 - DNA, 201 bp, Bos taurus; identical to SEQ ID NO: 70807

SEQ ID NO: 112191 - DNA, 201 bp, Bos taurus; identical to SEQ ID NO: 70811

SEQ ID NO: 112192 - DNA, 201 bp, Bos taurus; identical to SEQ ID NO: 70812

SEQ ID NO: 112193 - DNA, 201 bp, Bos taurus; identical to SEQ ID NO: 31102

SEQ ID NO: 112194 - DNA, 201 bp, Bos taurus; identical to SEQ ID NO: 31103

SEQ ID NO: 112195 - DNA, 201 bp, Bos taurus; identical to SEQ ID NO: 31104

SEQ ID NO: 112196 - DNA, 201 bp, Bos taurus; identical to SEQ ID NO: 31107

SEQ ID NO: 112197 - DNA, 201 bp, Bos taurus; identical to SEQ ID NO: 31108

SEQ ID NO: 112198 - DNA, 201 bp, Bos taurus; identical to SEQ ID NO: 31109

SEQ ID NO: 112199 - DNA, 201 bp, Bos taurus
cagtgaggcagcatcagagacttcgtgggtcccacagggcaccctggccccataagcttaagcctatagccccactatgtcctctgacctcacacttccakacccactaagtcaaggtctgggccttttgacttcttttgaaattctataggaagcaaatctgtgacacaaactattactacttgtgttatttggagtatg

SEQ ID NO: 112200 - DNA, 201 bp, Bos taurus; identical to SEQ ID NO: 31110

SEQ ID NO: 112201 - DNA, 201 bp, Bos taurus; identical to SEQ ID NO: 31111

SEQ ID NO: 112202 - DNA, 201 bp, Bos taurus; identical to SEQ ID NO: 70823

SEQ ID NO: 112203 - DNA, 201 bp, Bos taurus; identical to SEQ ID NO: 31113

SEQ ID NO: 112204 - DNA, 201 bp, Bos taurus; identical to SEQ ID NO: 31114

SEQ ID NO: 112205 - DNA, 201 bp, Bos taurus; identical to SEQ ID NO: 31116

SEQ ID NO: 112206 - DNA, 201 bp, Bos taurus; identical to SEQ ID NO: 31118

SEQ ID NO: 112207 - DNA, 201 bp, Bos taurus; identical to SEQ ID NO: 70826

SEQ ID NO: 112208 - DNA, 201 bp, Bos taurus; identical to SEQ ID NO: 70827

SEQ ID NO: 112209 - DNA, 201 bp, Bos taurus; identical to SEQ ID NO: 70828

SEQ ID NO: 112210 - DNA, 201 bp, Bos taurus; identical to SEQ ID NO: 70832

SEQ ID NO: 112211 - DNA, 201 bp, Bos taurus
aattttaatggtgtgctcacagactgccctctgccaagcgtggactctaggagtgagggtttgatggcccacgttggcttggccagaagccacagggtgcyttgatgactttgtggaatttaatgatttcattctgaaagataaattgggattggaggaggggagtaaatccgtgaggtggccatcttgacaggtgaagct

SEQ ID NO: 112212 - DNA, 201 bp, Bos taurus; identical to SEQ ID NO: 31121

SEQ ID NO: 112213 - DNA, 201 bp, Bos taurus; identical to SEQ ID NO: 31123

SEQ ID NO: 112214 - DNA, 201 bp, Bos taurus
caacagttcggacttcatggactccttataaaaggcctcagagacccccaaggggtctaccgaccacactctgagaacagctatcctaaatgaactttccrtgttatccaaagaggccaccgccctctcagaacgtaccagaatttcccttttctctctgacattgtcaatactccactcactgtagtcatttccatcagc

SEQ ID NO: 112215 - DNA, 201 bp, Bos taurus; identical to SEQ ID NO: 31126

SEQ ID NO: 112216 - DNA, 201 bp, Bos taurus
tacctttctctgttccaggtgggcactactgtgggctgttattacctatgcttttccaggcaaatgttactgcaaaaccattaatattattaaaggtattrtttggcctcactgtgtgtcaagcacatggacttgtgttttggtaacaatatctgtggagaaggcaatgacaacccactccagtactcttgcctggaaaat

SEQ ID NO: 112217 - DNA, 201 bp, Bos taurus; identical to SEQ ID NO: 31128

SEQ ID NO: 112218 - DNA, 201 bp, Bos taurus; identical to SEQ ID NO: 31130

SEQ ID NO: 112219 - DNA, 201 bp, Bos taurus; identical to SEQ ID NO: 31131

SEQ ID NO: 112220 - DNA, 201 bp, Bos taurus; identical to SEQ ID NO: 70840

SEQ ID NO: 112221 - DNA, 201 bp, Bos taurus; identical to SEQ ID NO: 31133

SEQ ID NO: 112222 - DNA, 201 bp, Bos taurus; identical to SEQ ID NO: 31135

SEQ ID NO: 112223 - DNA, 201 bp, Bos taurus; identical to SEQ ID NO: 31136

SEQ ID NO: 112224 - DNA, 201 bp, Bos taurus; identical to SEQ ID NO: 31138

SEQ ID NO: 112225 - DNA, 201 bp, Bos taurus; identical to SEQ ID NO: 31139

SEQ ID NO: 112226 - DNA, 201 bp, Bos taurus
gcctagtcactccgaggtcccttggcattggcagaggctctgtgtgtcttgacaagtggaagacggctttttgggtttgcaggttatgttgaacttttagrttaggccttctaagagccaggctcacaccatacctctgaccccacacattcagaatgggtggctggatctctgccttttcagcacttctcttcagaacct

SEQ ID NO: 112227 - DNA, 201 bp, Bos taurus; identical to SEQ ID NO: 31145

SEQ ID NO: 112228 - DNA, 201 bp, Bos taurus; identical to SEQ ID NO: 31146

SEQ ID NO: 112229 - DNA, 201 bp, Bos taurus; identical to SEQ ID NO: 31147

SEQ ID NO: 112230 - DNA, 201 bp, Bos taurus; identical to SEQ ID NO: 31148

SEQ ID NO: 112231 - DNA, 201 bp, Bos taurus; identical to SEQ ID NO: 31153

SEQ ID NO: 112232 - DNA, 201 bp, Bos taurus; identical to SEQ ID NO: 31156

SEQ ID NO: 112233 - DNA, 201 bp, Bos taurus
aaattcaacttccatagtcacattttccaaactctgctccttggaataaaatttccatgtggtactaattcatggggtggtggtggttggggcactgaggrgctggggaggtaagtccttgcctgaatatgtttggaaagtggtgagttaattaatcaaatgggtttcttttcctaggccctctcagggcttttatcatgt

SEQ ID NO: 112234 - DNA, 201 bp, Bos taurus; identical to SEQ ID NO: 31157

SEQ ID NO: 112235 - DNA, 201 bp, Bos taurus; identical to SEQ ID NO: 31160

SEQ ID NO: 112236 - DNA, 201 bp, Bos taurus
cgccctgcatcatctgtccacatttttaatctttaaattagaaaagacgtcttcctggtggaacccagcaatcactgacgacagtacacgtaaagtgcccrttgcaaggctggtccacaggaggtactcagtggattgtcattgttattaccaagtggagaatgatgctgcataaggaaaacaaagggcagggtcataaaa

SEQ ID NO: 112237 - DNA, 201 bp, Bos taurus
acaaagcctggattcgtttaccaggtggaggccttcgatccagaagacacaagtcaaaacctacccctcagtgtaagtttccttattaaatggaaaagcakcttttctgtgtggcctggagtctcagtggggcgggttgggaagtggcaatgggagggaagtgctgtccacctccaggcacagagcaccggggaggctgga

SEQ ID NO: 112238 - DNA, 201 bp, Bos taurus; identical to SEQ ID NO: 31357

SEQ ID NO: 112239 - DNA, 201 bp, Bos taurus; identical to SEQ ID NO: 31358

SEQ ID NO: 112240 - DNA, 201 bp, Bos taurus
tctagagtgggagtgagacatctactgtccaagtccacctggggccacgggctggtgatctctgccgcttgtgtcccacccttggggcacagaatgttctraccagtctgtttatggcccttttgcctcaatacaccatgcgccactccctggaatcctgctgcccccaaagtactgcccacggcctccttcctactgtgc

SEQ ID NO: 112241 - DNA, 201 bp, Bos taurus; identical to SEQ ID NO: 31361

SEQ ID NO: 112242 - DNA, 201 bp, Bos taurus
attatggcaaaatatacataactaagaataatagatgaatcatggctaaaacctacccccaaagaaatccaactttcctcttctccaaagtactactctgragccaaaactgaggctcccaaggaagggaaacattagagtaccaggttgacaaataaaagtaaattcattacttatatattttacattcacttcaacatt

SEQ ID NO: 112243 - DNA, 201 bp, Bos taurus; identical to SEQ ID NO: 31364

SEQ ID NO: 112244 - DNA, 201 bp, Bos taurus
ttttttcttctgtcattcctgggtgttgagcattgtggcagacactaattattgctcccagaatttgttctacttcatctccaaatatttgcttggcacayaactgctcaaaatagtttccattcccaagctttccttatagccatgcatctgagttactgttgttgtgtaataagtcaccttaaaatgtagaggttgaaa

SEQ ID NO: 112245 - DNA, 201 bp, Bos taurus
aggtgacctatacgttgatgagaaagtagggcctgggtagtgggaaccttccctcctgaatcattcactgctaagacacaaattcatgacttctcttggtrggagaaggccaggaccttcagtgagttaggggtggggtggggggagtcccctgcattctctgagttcagaaggaagacaagtaagaggattctggcttca

SEQ ID NO: 112246 - DNA, 201 bp, Bos taurus
aagtccattagtatgcagtaggtaggataggtttttaaatgttttcctgtataaagcaattatctacttgaaataattaaaacattaagaattttaaaagytagctttccttaatgatatagttttaacttgaaaagatcagtttaaagccatatttatttattttaaaaaaatcactttttctaagttgactataatgtc

SEQ ID NO: 112247 - DNA, 201 bp, Bos taurus
gaaataaaagtatatgtccatataaagatttatatatgaacactcaaagcaccttgatttgtaatagccaaaaactggaaacaacccaaattgtccatccwcaagtgaatgcatgtacaaactgtagtatacttgaacaacagaacactatacagaagtacacattacaatatggatgattctaaatacaatcctgctcca

SEQ ID NO: 112248 - DNA, 201 bp, Bos taurus
taaagcattcacatttggcaatattaacttcaaaactaaaagttttaaaagtaaacacatttttttttgactaataaaacataaacgatttaacaattctyacaaaatctcacagaactgaatgaaggaaaatcatcattactttttctacaactacagaattaccaaatgttagatcataaactcgtgattctgtagtga

SEQ ID NO: 112249 - DNA, 201 bp, Bos taurus; identical to SEQ ID NO: 31368

SEQ ID NO: 112250 - DNA, 201 bp, Bos taurus
atttcctgggagaatctgggcaagccacttaaattcctcatatgcaaaatggaaataataaccctcatactggaagggaggaaatactttagcccaggccragcatctagctgtgtggggacacagccctacccaccagcagaaaggcaaacttggattccctcagctaccttggccacacagagaatctgaccttgccca

SEQ ID NO: 112251 - DNA, 201 bp, Bos taurus
aatatggtttttgagctgatggagagattataaagtagtaaataagcctaaagtatttaaccttagggctccagttatctgtcgttggtaggactttggargtggtatttaacctcatccaagaagtgtaaatacttggaatccttcatatagtttaaggataaagtgagataatgctcagaagtgctgagattcctcagc

SEQ ID NO: 112252 - DNA, 201 bp, Bos taurus
ccacaggccacctattcccaagatgccccctgctgcaaagcagacatactctagcatccttagctgcttttcattttagtttggagaaacttgtgatgackagttttaattagaatttataaggaaggagtcactattgaagaaagactgagagaattggcgtttcatgcctgcatatggcagctttgtctcatgttaggt

SEQ ID NO: 112253 - DNA, 201 bp, Bos taurus
gtgctgggtattctagtgcccacaagggggcagcactcctcacccaccaagcaggctttctcttcccttcccgttctacagggttggtctagggtctcttyctagcaggtagcttggcctaatattaggtatctgccctttccatatctaccttgagcctctccttttactgggatccaagcactttgttttctcctttga

SEQ ID NO: 112254 - DNA, 201 bp, Bos taurus; identical to SEQ ID NO: 31371

SEQ ID NO: 112255 - DNA, 201 bp, Bos taurus
tagtaaaaacagtgctctgccttgtacatgactatttcattaattcactgagccacccccaaccagtaagatgcagacatataactgaagctgcaggactmccagttaatgacattgtggagcataaaccacaagcaaatgctcagaacactaagaactgggttggccaaaaagttcattcagctttttctgtaacatctt

SEQ ID NO: 112256 - DNA, 201 bp, Bos taurus
gggttttagcgggaagaaaacatttttctctgtcttcaggcaaggcataatgaaaaagcagcaatttcaatacttctcttccttccaacagcagacggtaytaggaacagtaccagacagggaatgcatttgaccttacatttgcccaagaggcactgaagtctccagcccagaagctccatcagctgctcccaggggcca

SEQ ID NO: 112257 - DNA, 201 bp, Bos taurus
atggcaagaccctggtttctcaccactggactgagtttacagatgggctaggggaagagactagactgatccttggggtaatggattagagtgggagacaytgtaaaaacttatgtttagcttcatttagatatacatagttacataagaatatttacagacagtttatggcacaagttattatgggcctatacatttcct

SEQ ID NO: 112258 - DNA, 201 bp, Bos taurus
tgggccacagacagcagctgctacgagtcgtccatgtcaagtaactgataccctgccccctccttgatggaggttctcttggtcacagatgtgtgacacaygcatatttatcactggccccactcctaactggagaggggactggagaagaaatggggagggctgaaattatgctcagatgatgagcagagcccttcccat

SEQ ID NO: 112259 - DNA, 201 bp, Bos taurus; identical to SEQ ID NO: 31375

SEQ ID NO: 112260 - DNA, 201 bp, Bos taurus; identical to SEQ ID NO: 31376

SEQ ID NO: 112261 - DNA, 201 bp, Bos taurus
aagcccgtgtaccgcaacaaacagtaaagcctgccggtagcaacaaagacccagcccagctaaaaaataagtaaatcttaaaaaacaacaacaacaaaatmatagagtcagatgaaataaagatatgattgggcagaaaagctatttctcagtcaacagacactaggatgagtattaaacttttcattacctcattataag

SEQ ID NO: 112262 - DNA, 201 bp, Bos taurus
aagctttcctttaaagaacaagaatcataaagcacagagatttgctacaagccatggggttgaaaggatgtagactgtaatcttcctagaggcctttcttrtcacacaggaggtgacagcctggagagggtgagaggagagaaaggtgaggtgagtgtggagcctctgttaatgttttggccctgctcctctcccaccata

SEQ ID NO: 112263 - DNA, 201 bp, Bos taurus; identical to SEQ ID NO: 31383

SEQ ID NO: 112264 - DNA, 201 bp, Bos taurus; identical to SEQ ID NO: 31384

SEQ ID NO: 112265 - DNA, 201 bp, Bos taurus; identical to SEQ ID NO: 31385

SEQ ID NO: 112266 - DNA, 201 bp, Bos taurus; identical to SEQ ID NO: 31386

SEQ ID NO: 112267 - DNA, 201 bp, Bos taurus; identical to SEQ ID NO: 31387

SEQ ID NO: 112268 - DNA, 201 bp, Bos taurus; identical to SEQ ID NO: 31389

SEQ ID NO: 112269 - DNA, 201 bp, Bos taurus; identical to SEQ ID NO: 31390

SEQ ID NO: 112270 - DNA, 201 bp, Bos taurus
attgagacatcagtgtcaggtaacagcaaagcactgacagcaaggtcgtggggagtctatgctgcaactgaagctgcagtgagtcagaaccacatgaaaartaagatagtgagggcagaggagccattatgaaggccaacatggagaatattaatcttcagacaaggaagagagagagagggagagagggagagggacttt

SEQ ID NO: 112271 - DNA, 201 bp, Bos taurus; identical to SEQ ID NO: 31395

SEQ ID NO: 112272 - DNA, 201 bp, Bos taurus; identical to SEQ ID NO: 31396

SEQ ID NO: 112273 - DNA, 201 bp, Bos taurus; identical to SEQ ID NO: 31397

SEQ ID NO: 112274 - DNA, 201 bp, Bos taurus; identical to SEQ ID NO: 31398

SEQ ID NO: 112275 - DNA, 201 bp, Bos taurus
acagagaaccaggaaaggaggggagctggccccccttgtctgtctctagccagacgagggggaccagctcacacaagaacatattggtttaaatgagaaayaccaaaaatggcctgaacttaagaaatgataatgtcagtgtaaaataatggactcaaaagttaactagcacagcgtgcctttttcacaggggataaacac

SEQ ID NO: 112276 - DNA, 201 bp, Bos taurus
tcttcattatgcagcttctaatttataggacaaataatgaattacgtatatggaaatgctttttctaacattagtttaagagattgacacaaactagaatkaattacacagttgacaaacagcagaagtcaaagaccttgaagctgtgattaaaaaaacacaaataagtttctgtatacttccttagtcttggaatcatat

SEQ ID NO: 112277 - DNA, 201 bp, Bos taurus
ccacaggaggtcaagagcagcagctagggagtatttattcacattcttgttctctcactgcccagtgatgctactccctcttccatttgataaacctaccyatctggcccatccacccacaaggtagaccctctccaactcccaacagaaagtaaagggaaagaccctttgctctcaatttacctctgcaatcttcacctc

SEQ ID NO: 112278 - DNA, 201 bp, Bos taurus
ccctagaaacaaagaaacaaactaattgccattaaagtttgtattgttgtcatgactagaatcctggttatatcttatgccttggaaaacagaaatacacwtgcctgcattgtagcaaactagtgtgatgggcaaaaaggaagtgaatctggctttctcatcttaaagaaaacatgactgtggccttttcaaaatgctgcc

SEQ ID NO: 112279 - DNA, 201 bp, Bos taurus; identical to SEQ ID NO: 71036

SEQ ID NO: 112280 - DNA, 201 bp, Bos taurus; identical to SEQ ID NO: 31404

SEQ ID NO: 112281 - DNA, 201 bp, Bos taurus
aatgatgagatttaaaacttcaaaatctccttaattaggccctattctagtaccacttaataaagttgtgttggagaaacactgtcattgcacagtttccratgacataatccgtcacagctcagtgagtcaaaacattagctaaaaaagtcttaggattaggtcacgatgttttactgaacaataaggtagaactgaatt

SEQ ID NO: 112282 - DNA, 201 bp, Bos taurus
ctttttttttcctaagtaagatctgccaaatgttcatggacaaaaacctctcattgcaaactgaactagtgaaatgacaagggtaagccacgtttctttcmatagctttatggcattaataaagctactgtttgaatgcatgttaatattgtcatgtgtaggatgaagtctcacaaattccccaaaatgtgaatgatcaat

SEQ ID NO: 112283 - DNA, 201 bp, Bos taurus; identical to SEQ ID NO: 31405

SEQ ID NO: 112284 - DNA, 201 bp, Bos taurus; identical to SEQ ID NO: 31406

SEQ ID NO: 112285 - DNA, 201 bp, Bos taurus; identical to SEQ ID NO: 31407

SEQ ID NO: 112286 - DNA, 201 bp, Bos taurus
aggggatcactatagatgccaggcctcaaatggatcctctgggatctctacgagcctaatttcccacctgaagcccatctgcagcctgtaaaaatggagcrggggccaagaacacggggccaataaagctccaggcaaaagatgattgtgaagtgggacacaagtttttcaccttcttccaattctgctgaccatgactcc

SEQ ID NO: 112287 - DNA, 201 bp, Bos taurus; identical to SEQ ID NO: 31411

SEQ ID NO: 112288 - DNA, 201 bp, Bos taurus; identical to SEQ ID NO: 31412

SEQ ID NO: 112289 - DNA, 201 bp, Bos taurus; identical to SEQ ID NO: 31414

SEQ ID NO: 112290 - DNA, 201 bp, Bos taurus
cagtcacaatgtctaaaacactcagggccctgggagatacagttgaattctgttggcaataatccactgtaagcctctagcttctgttagcttgtttaagyggccatattaagataaacatttcttaatgttgctttgcctttaagttcttaattaagagagatgttaattaaataatggtttccctttgttttcatggga

SEQ ID NO: 112291 - DNA, 201 bp, Bos taurus
gagtggttagtattatatttaacccatggtgtttttttgcacgaatctttgaaagttatgtgaaccaaaactagatagcacaatatgcttgtctactaaayaagaaagacaggcaccacaaaaaaactattatatgttgaaagtgaactaataaatatgggcaggatgtttgactcccactctttctagaatagctgggag

SEQ ID NO: 112292 - DNA, 201 bp, Bos taurus
tgtctatgctattagaagtttcagtaagtacttattatttgtgcattgaatttatttcctaagtaatcctgaagaagaaattaaatggtagcactgaataracaagcctatatgctaataaatgtatgatattgaaactaatgttactgctttttaataatattgcaggttgggagtttttacacacaaatgtgtgaactc

SEQ ID NO: 112293 - DNA, 201 bp, Bos taurus
aggaggccacctagacccaaaaggcagagcctgcgggggctaccctaaattctttgaacaaaaactctttccttgaagcacatccggactaatatttccarttattggcctactgctgcccccctttctattaataatgagacaaattactgttgtttccttgttaatttttacctgtgcttctcacttatattcctgtgc

SEQ ID NO: 112294 - DNA, 201 bp, Bos taurus
aaatctccctaccaaagttagaacagcggtccaaaggctccacagaaaggcagcagaactccttattcctcctgctttccatttctagaaccatggattayctctgagggtatctgggattatttaatttacacctccatcttgttttcttaagtatttcaagtggttataaagcaacatagcagaaaattagtaaaggaa

SEQ ID NO: 112295 - DNA, 201 bp, Bos taurus; identical to SEQ ID NO: 31415

SEQ ID NO: 112296 - DNA, 201 bp, Bos taurus
gttatcagtcagaaaaatattaaaatgcatgttaacctgttaacaatgatcttctcaagacataggataatgggtgatctttattatacttttctacattwaaaaaaatcagtgttactagtagcagtgataatattttaaaagtagttagaataaattggataggttactgatactgaaacagaaaagaagaacacagaa

SEQ ID NO: 112297 - DNA, 201 bp, Bos taurus; identical to SEQ ID NO: 31420

SEQ ID NO: 112298 - DNA, 201 bp, Bos taurus
gatttaattgtggaagtagacatgggctacaatgggatatttaaaaattcttgattctgatgtgcagcacattctgtgaagcattgctctgagcttctcartttagcttccccacaaaatttgatagattgtgttttcattttaattcatttcaagatatttaaaaatttcccttgtgatttctctcttttctccattggt

SEQ ID NO: 112299 - DNA, 201 bp, Bos taurus; identical to SEQ ID NO: 31425

SEQ ID NO: 112300 - DNA, 201 bp, Bos taurus
taaaacaaagcccaggaaattatgcaaaccttgcttctcttgacttgtctgtttcctgtttgaaacatgccaagacacccccatggcagagcaagataaarcaaaagtctgtcagatctagtcctaaggactcagtcggaagtatggcccaagatggcactgtcaagatgaatggtttgttacatgatcttaaaggtaata

SEQ ID NO: 112301 - DNA, 201 bp, Bos taurus
cagaatgtacgtgtttgaccttggtattttgaacactgccaagagcaatattctcttaaattttctcctcctaattagtacaagctgtctcttgctttttrtctctctacatttaagtggaaatatgagtcaaaaaaagacaaattgttctttgctcctttcctagctgccaccaagacaaatgatgctcctataggttat

SEQ ID NO: 112302 - DNA, 201 bp, Bos taurus
gccaaaaggaaagataaaaacaaggatgctagtgaaatctaaagcctctgaaacctgtaactcctattttagcccaactcctagctattaaaatatatcartaattgattaataatatttttattatttagtatgttaatccatgggttcttgtactaaaggtctatttatctcatttcctgttaccctctacaacaggcc

SEQ ID NO: 112303 - DNA, 201 bp, Bos taurus; identical to SEQ ID NO: 31437

SEQ ID NO: 112304 - DNA, 201 bp, Bos taurus; identical to SEQ ID NO: 31439

SEQ ID NO: 112305 - DNA, 201 bp, Bos taurus
tgcttttggaattataaatttagtgagttagtgtattcaaaaatatggagtctgaataatgaggctttcgtatatgttaggcagaacccctaataatataytatctactttctgagagttattttgcctacctccaaaatattctactagaattataaatacatgttttaaaagtgcttaatattttttattcaacatagg

SEQ ID NO: 112306 - DNA, 201 bp, Bos taurus
ctatactgttctctagagcctttcttgatgtgttagtatacattctgtcacagacttagtgtacgaggactgtcttaagttacacatgaaagacacaggaraactaatttggtcacaaaacatccccatatggggggcttccctggtggctccaaggccaaatttgcctgttactccaggtgtttcttgacttcctacttt

SEQ ID NO: 112307 - DNA, 201 bp, Bos taurus; identical to SEQ ID NO: 31442

SEQ ID NO: 112308 - DNA, 201 bp, Bos taurus; identical to SEQ ID NO: 31443

SEQ ID NO: 112309 - DNA, 201 bp, Bos taurus
cccataatgcttatcaacaggtgtgtgacaggagaatacccaaagccagaaaaagaatcacccagtagactagaagtaagctgtgttagcactgacatggygctgaaaatagtggcctaactggaaaacctcatgattcatggagcactaggtagagtatgcagcaatcttgcctcagctgtggggaataattggtaataa

SEQ ID NO: 112310 - DNA, 201 bp, Bos taurus; identical to SEQ ID NO: 31445

SEQ ID NO: 112311 - DNA, 201 bp, Bos taurus
tgtagcacaagtgacttagctgaggtcattaacgcatacacgtcagtgtcagagaggtattaatagaaaagcccgggcctgagccagaatttagctgacaygcccagcccaactacattctctgacaggcgtgtgacattggtactatttccaaactcttctgggcctcatttttcatacttacaaaatatggataatacc

SEQ ID NO: 112312 - DNA, 201 bp, Bos taurus; identical to SEQ ID NO: 31447

SEQ ID NO: 112313 - DNA, 201 bp, Bos taurus; identical to SEQ ID NO: 31449

SEQ ID NO: 112314 - DNA, 201 bp, Bos taurus
aggctgtttctctgaaggtaattttgcataccatatttctaacaccatgactttgaccctagaatgactgcagtcatattttgacaatatctcttattaamgtattcactcttcaaccccagacaatggctttttttttttttaatgtacaccttcttgtctgtaataatggttaaaaagagaaaagaaaagaaagaagtt

SEQ ID NO: 112315 - DNA, 201 bp, Bos taurus; identical to SEQ ID NO: 31453

SEQ ID NO: 112316 - DNA, 201 bp, Bos taurus
gtgtggtctgggcagggcccagcctcctcccttaattaaaaatatcatcttggagtttccggtcaatagagaatgaatttccaattgctttaccctgctgrggccagtctgcctcctggctcaaaacttctaacagcagtgaatgagactctaatagtaactgatagcagctaacctttttttaagtcttattatgtgcca

SEQ ID NO: 112317 - DNA, 201 bp, Bos taurus; identical to SEQ ID NO: 31459

SEQ ID NO: 112318 - DNA, 201 bp, Bos taurus; identical to SEQ ID NO: 31460

SEQ ID NO: 112319 - DNA, 201 bp, Bos taurus; identical to SEQ ID NO: 31461

SEQ ID NO: 112320 - DNA, 201 bp, Bos taurus
tgggccttgaggtccgagttcatctccagttccaagagggcctgggagatgcccaattcagactcctccaacttctctatgttgggcttcatgatcttcaygctggaaatgaacatggcctgcacctggcagatgtggccaacacttgttgctgccactgacaccagtaggcctaggaagagcaaatcttagatttttaaa

SEQ ID NO: 112321 - DNA, 201 bp, Bos taurus; identical to SEQ ID NO: 31462

SEQ ID NO: 112322 - DNA, 201 bp, Bos taurus; identical to SEQ ID NO: 31464

SEQ ID NO: 112323 - DNA, 201 bp, Bos taurus; identical to SEQ ID NO: 31467

SEQ ID NO: 112324 - DNA, 201 bp, Bos taurus; identical to SEQ ID NO: 31468

SEQ ID NO: 112325 - DNA, 201 bp, Bos taurus
cactagcaccacctgggaaggattaatcatgcttggccttctaacaataagccaattacaaagttttctgggcatatttagactttcagatgttgatactktgtaaggccatactgcctatggggcggcaatgcactcatttattgctctgtcctaataagtgctaagtgccttaaccatcttaaaggtcctggcctcctc

SEQ ID NO: 112326 - DNA, 201 bp, Bos taurus; identical to SEQ ID NO: 31469

SEQ ID NO: 112327 - DNA, 201 bp, Bos taurus; identical to SEQ ID NO: 31470

SEQ ID NO: 112328 - DNA, 201 bp, Bos taurus; identical to SEQ ID NO: 31471

SEQ ID NO: 112329 - DNA, 201 bp, Bos taurus; identical to SEQ ID NO: 31472

SEQ ID NO: 112330 - DNA, 201 bp, Bos taurus; identical to SEQ ID NO: 31473

SEQ ID NO: 112331 - DNA, 201 bp, Bos taurus; identical to SEQ ID NO: 31474

SEQ ID NO: 112332 - DNA, 201 bp, Bos taurus; identical to SEQ ID NO: 31479

SEQ ID NO: 112333 - DNA, 201 bp, Bos taurus; identical to SEQ ID NO: 31480

SEQ ID NO: 112334 - DNA, 201 bp, Bos taurus; identical to SEQ ID NO: 31481

SEQ ID NO: 112335 - DNA, 201 bp, Bos taurus
tattctgccttgactgtcctagggcccaggactgttttgtggttagatgacagtttttctgtaaatttaagccaagcagaaatgtctgtcctcatgttttkctgaatgtgtggcctcctccctacacggtcctctcttttcataccagagtcctcttgggtgcctctctgcaaacccaccaggatagggttaccctcagac

SEQ ID NO: 112336 - DNA, 201 bp, Bos taurus
tctccctctcaaggctctggggagaattctttcctggtcttttccagctttaggtggctgccagagttctttgaattgtggtcacaccaataccatctttkagcccatggttacagggcctcttctgtctgtgtgtcaaatcttcctctgcctccctcttacaaggatctgtatttttgcctttggactcaatagtaataa

SEQ ID NO: 112337 - DNA, 201 bp, Bos taurus
cgtagagtttgtgaactatttcagaatatagttggggattaaatgccccctagtggtcatgtgaggcaaaaattcaagccagatgcttaatacagaacggrggtagtaagtgaatttggaatttttcaatgactatagtgtgttttcaactcagttacatagttgtgggcttatgattaattaatttgcttttaacctaaa

SEQ ID NO: 112338 - DNA, 201 bp, Bos taurus; identical to SEQ ID NO: 31482

SEQ ID NO: 112339 - DNA, 201 bp, Bos taurus; identical to SEQ ID NO: 31484

SEQ ID NO: 112340 - DNA, 201 bp, Bos taurus
cagacctcttcccttcctaactgcaactggttatcatatcaaacaaaatgactgagaagtaaagacagaatttccagtccaagccctggggccagacttcyttgatttgggctccacaacctatgttgggcatcattcataacctcaaagcctcagtttccttggctgttaaatggagctaatgacatttacttggccata

SEQ ID NO: 112341 - DNA, 201 bp, Bos taurus
tctatttagagcttaatcagcaaaatgaaaatgaaatcattaaaaggtcaatagggtcagtgcagtttcacactaattgccgaaaacttttgtctctttcmaggtggagaattttagaaaagagagaaaatataggagcctctggattccaggggtctttctaactaacattcccactgactcacatcctgaaacgagatc

SEQ ID NO: 112342 - DNA, 201 bp, Bos taurus
gcctatcttgcctccatatctatgtatctacctctattttgttctgttcgggcagtttcattttttttacatttaaatctcctacccatctgaaatgtatygtggcacatgttatggcctagggaatctacttttcctccaaatggtcggtctgctcccagcgacatttttcaattaattctccgagtcctttctgcattg

SEQ ID NO: 112343 - DNA, 201 bp, Bos taurus
tggagtgcctcagcttggacccctgcttaacctcccaacagtatcctcagaagctgagcgtgtactagtgtccccgtgtgtgcagtagtaggctcagaccycaaggccaaaacagccagtctcattttgcaaaatgacctgctatgtaacaactgtattgcacagcaaacaccaccagcctggccaagggaaaggagccca

SEQ ID NO: 112344 - DNA, 201 bp, Bos taurus
acaggtttctgactgttgaaaaaaagaaactcttgacatagttactttctttcaacattatgaaagttgaaataaaggtgaaagttctttgacaaagtcamgacttttcttccaaaattctagaataaggtatagaaattgtggtgagcaactggaaaagcctcattcattggaaaccagatccttcccatgtaagaatca

SEQ ID NO: 112345 - DNA, 201 bp, Bos taurus
caaaataagaactacaattttaaaaacattgccaaggtgcctcattagcacagtaggtagggtgacaattacataaaaatattgctaagtaaccaaagtgkatatcaacagaaaaaatatgaatatggcatctctaaggctttttaaactaagacaactgtacagaaatgcttaaaagcacaaatgcaacattgctgaatg

SEQ ID NO: 112346 - DNA, 201 bp, Bos taurus
aagatataattgtattaggcctgtcatgtgtctatgttatgctagtcaggatcctcatcactttgttctgttgaattgcaacactttttgttgaataaaaytggttttcagccatatagtcacgctccattctaatttctcctacaaaatactttatatgctggttgaaattcctacagccccttcatttcatttctctac

SEQ ID NO: 112347 - DNA, 201 bp, Bos taurus; identical to SEQ ID NO: 71041

SEQ ID NO: 112348 - DNA, 201 bp, Bos taurus; identical to SEQ ID NO: 71044

SEQ ID NO: 112349 - DNA, 201 bp, Bos taurus
tctgaacaatagaaggggaggcattactatgaagttttaaaactcatactactttgaaattatcacacaagaattgtcacaggggaacacagtaagactgygatttcttcttgttttacaccacaggactgaaaagggagttgaaggagattaattacattccctgctaatcaatgcaaagacatatttttctgcttctcc

SEQ ID NO: 112350 - DNA, 201 bp, Bos taurus
cttaattatttaagactgacataacaatagaaagattcctgtgataaaaaaaaaaaagcgctagctgaaactggagttcactggtacagtacacaaggtartgaaggaaggtaaatacacatacacaaactcacaaactctagtgattgttttccatttgaaagacaaagaaaaccatatatctgcattttatatacattt

SEQ ID NO: 112351 - DNA, 201 bp, Bos taurus
gctgcctgacctcagctggcccgggctgcagggaaaaggaggcccagggctttctgctgacttggtgctgaacttaaaggatgagtccctggcctccttgrtgcctgctttcccataaggacactgccagttactaagcagcaagaatttacatacatcatcacatgtttaatcctgcagcctccagtccaggtggttact

SEQ ID NO: 112352 - DNA, 201 bp, Bos taurus
ttcttgtttctggcctagctctagccttcggtacagctgatttttctgtgtatcttgggaagattaaagggggtgaattaggaggtgtaagtcttcagctrtcataaccttcatggcctgtaatttgtcattgtcaggttatgttccagcaagggctgaggactgtggaaaagagctcaaaacggaaggaagcacacttta

SEQ ID NO: 112353 - DNA, 201 bp, Bos taurus
tttctccgccctccccccccaccccacatggcatccccttccccatcccagacattctaacctccactccggcgaccctcgggccaaaggacaaaagaggyttgaggaggcaccagagcactgaccgctagcaggcatgcagaatgcaaaaggggtgctggccctggaagactgccttgccttcatcccaggctaagtctc

SEQ ID NO: 112354 - DNA, 201 bp, Bos taurus; identical to SEQ ID NO: 71048

SEQ ID NO: 112355 - DNA, 201 bp, Bos taurus; identical to SEQ ID NO: 71050

SEQ ID NO: 112356 - DNA, 201 bp, Bos taurus; identical to SEQ ID NO: 71054

SEQ ID NO: 112357 - DNA, 201 bp, Bos taurus; identical to SEQ ID NO: 71055

SEQ ID NO: 112358 - DNA, 201 bp, Bos taurus; identical to SEQ ID NO: 71056

SEQ ID NO: 112359 - DNA, 201 bp, Bos taurus
tattttacaggccaggaagctgaggagaataatgtgtccaagaccacggagccaggtaggtgctgaaaacaaggtaaatccccaggttttctgatttgctmtccattccttcccacccatggccccagccaaccaccttcttacacattcagagtgttcttttatatcaacatttaaaaatatttcatgaattggggataa

SEQ ID NO: 112360 - DNA, 201 bp, Bos taurus; identical to SEQ ID NO: 71059

SEQ ID NO: 112361 - DNA, 201 bp, Bos taurus; identical to SEQ ID NO: 71060

SEQ ID NO: 112362 - DNA, 201 bp, Bos taurus; identical to SEQ ID NO: 71063

SEQ ID NO: 112363 - DNA, 201 bp, Bos taurus; identical to SEQ ID NO: 71070

SEQ ID NO: 112364 - DNA, 201 bp, Bos taurus; identical to SEQ ID NO: 71071

SEQ ID NO: 112365 - DNA, 201 bp, Bos taurus; identical to SEQ ID NO: 71072

SEQ ID NO: 112366 - DNA, 201 bp, Bos taurus; identical to SEQ ID NO: 71073

SEQ ID NO: 112367 - DNA, 201 bp, Bos taurus; identical to SEQ ID NO: 71074

SEQ ID NO: 112368 - DNA, 201 bp, Bos taurus; identical to SEQ ID NO: 71075

SEQ ID NO: 112369 - DNA, 201 bp, Bos taurus
gtggccggagctgggattttaacccaagtcgtccagccaaacgtaagattctgtttgtgaggttaacactgaacccccagggccgaggactacgtcccctkacaccgcagataaaccaactgcagtgcctcggctaagactgaaagacccggcagtggccaccctcctcaggctggatggatggatgctgcttccgccact

SEQ ID NO: 112370 - DNA, 201 bp, Bos taurus; identical to SEQ ID NO: 71076

SEQ ID NO: 112371 - DNA, 201 bp, Bos taurus; identical to SEQ ID NO: 71077

SEQ ID NO: 112372 - DNA, 201 bp, Bos taurus; identical to SEQ ID NO: 71079

SEQ ID NO: 112373 - DNA, 201 bp, Bos taurus; identical to SEQ ID NO: 71080

SEQ ID NO: 112374 - DNA, 201 bp, Bos taurus
tgctgcacatggggaggtataatgactgtaattacttggatgacatttaaaaattaacaaattctccttcaaattcgattcttccctgtgtgctgccagcsctctttcctctaatcacgtcaattaaatgttcttacagtgtcaccctccataacaccctttaatgtagtgatttgggaagtatatttaaagcaattaaat

SEQ ID NO: 112375 - DNA, 201 bp, Bos taurus; identical to SEQ ID NO: 71083

SEQ ID NO: 112376 - DNA, 201 bp, Bos taurus; identical to SEQ ID NO: 71084

SEQ ID NO: 112377 - DNA, 201 bp, Bos taurus; identical to SEQ ID NO: 71085

SEQ ID NO: 112378 - DNA, 201 bp, Bos taurus; identical to SEQ ID NO: 71086

SEQ ID NO: 112379 - DNA, 201 bp, Bos taurus; identical to SEQ ID NO: 71087

SEQ ID NO: 112380 - DNA, 201 bp, Bos taurus; identical to SEQ ID NO: 71088

SEQ ID NO: 112381 - DNA, 201 bp, Bos taurus
aagatgaaagaacaaaaaagtactcagtagagtccctggccaccagtacacactacactctcagtcagcgtccaggttcttttgtctgtacagcgtggccrccggctctccgctctgagtgcagacctcgtgtttcccacgggtttccgcaggattggaaagctaggtgacctgaggcagagttggccgctttgtcatcag

SEQ ID NO: 112382 - DNA, 201 bp, Bos taurus; identical to SEQ ID NO: 71089

SEQ ID NO: 112383 - DNA, 201 bp, Bos taurus
ttctgatgtcagatttggatggtggtagactagctgtagcactgacattaaaattctgcttctgtaagaaattgaatatattaggaaagaaggccaataarccattattttttcctaataagagtagctgacccttcactaaatactgaactaaatgacagctttacaaaactatttcaagtattcattatcacagtgaaa

SEQ ID NO: 112384 - DNA, 201 bp, Bos taurus
ttaatttcatgactgcagtcaccatctgcagtgattttggaggccccccccaacccagaattaagtttctcactgtttccccatgtgtttgggtgctagasaaatctatttccttctgggcccagaaacagggaaattttaggagccgctggaggccatatcttctattaagaggactaggaagtggtcctccacagcatt

SEQ ID NO: 112385 - DNA, 201 bp, Bos taurus; identical to SEQ ID NO: 71090

SEQ ID NO: 112386 - DNA, 201 bp, Bos taurus; identical to SEQ ID NO: 71091

SEQ ID NO: 112387 - DNA, 201 bp, Bos taurus; identical to SEQ ID NO: 71096

SEQ ID NO: 112388 - DNA, 201 bp, Bos taurus; identical to SEQ ID NO: 71097

SEQ ID NO: 112389 - DNA, 201 bp, Bos taurus; identical to SEQ ID NO: 71098

SEQ ID NO: 112390 - DNA, 201 bp, Bos taurus; identical to SEQ ID NO: 71099

SEQ ID NO: 112391 - DNA, 201 bp, Bos taurus; identical to SEQ ID NO: 71101

SEQ ID NO: 112392 - DNA, 201 bp, Bos taurus; identical to SEQ ID NO: 71103

SEQ ID NO: 112393 - DNA, 201 bp, Bos taurus; identical to SEQ ID NO: 71104

SEQ ID NO: 112394 - DNA, 201 bp, Bos taurus; identical to SEQ ID NO: 71105

SEQ ID NO: 112395 - DNA, 201 bp, Bos taurus; identical to SEQ ID NO: 71106

SEQ ID NO: 112396 - DNA, 201 bp, Bos taurus
agattctgaactgtcctgacttgccaatcactattttgagttaagaattcccattgttctttcattgtggaccctgatctgtattcggccatgaaaacagragggctcttaaccatcacttcacccagagctttgagctgggaaagttcttgacccttactgacctctctcagcttttctgttctcccttaaggccaagac

SEQ ID NO: 112397 - DNA, 201 bp, Bos taurus; identical to SEQ ID NO: 71108

SEQ ID NO: 112398 - DNA, 201 bp, Bos taurus
ctctccctctctctatgagattcctaactgcagagtattaagtttatccctctgattttcttactatagtaagactgagctgattacccctttactacttyagctacgccatctattatcaggcctacatttccttccctagtcaatcagaggtcctttacacctgccttcaggcaactccattctctatctgtgaaagtg

SEQ ID NO: 112399 - DNA, 201 bp, Bos taurus; identical to SEQ ID NO: 71109

SEQ ID NO: 112400 - DNA, 201 bp, Bos taurus
ttaactatacttcaacttttttaaaaagctgtaaatcttaataataacgctgcattagtaaggagaattatatgtcccactctctaccccagggataagtrgggagttgagaagaaagaggttaaagctgagaaaaaataataattaaagggatacataaatgccaccccaatgtttacctgattgaatgccacatactat

SEQ ID NO: 112401 - DNA, 201 bp, Bos taurus
ctatgtagagccttactactcaacctgagattcaaggaccagcagcacttgtatcctctgggagcttgtcagaaatatagaatctcaggcctcgttcctgrtgtacagaatcagaacctgcatcctcataagatctccaggtgcttcctctgcacatgcgtggcatagtgctaagtgtgtcataagcagtataggccactg

SEQ ID NO: 112402 - DNA, 201 bp, Bos taurus; identical to SEQ ID NO: 71111

SEQ ID NO: 112403 - DNA, 201 bp, Bos taurus; identical to SEQ ID NO: 71112

SEQ ID NO: 112404 - DNA, 201 bp, Bos taurus
agatgtggctcccagcccattccccaaatgagtggccatgctgtttactcccaaactgagaaaccctagacagtaagcggggccttgagagttcatgccaygacagctggcatccacagagattctgcctgtcccaggcaaaccaggattgtggcctctgaacacttggagccctgctttagaattgcctgttcaaatgta

SEQ ID NO: 112405 - DNA, 201 bp, Bos taurus
gagattttaatgattaaactctctttgagaacacgttgatggggttgggtgcaatcccagctccatcatggcctcactgagtttgagggtgacccaggtaygggggaagtcaccccaaagtcctaccttctccacagaaagatgagacccagtcgccttcctcacacccgtcctgggactacagatacagattcatagtgg

SEQ ID NO: 112406 - DNA, 201 bp, Bos taurus
tataaaatgcttggactcagagaccttgcaaggtcattcacatttcatttttgtaattctacaaaatcagaaaaatgttgatattgttgactttgggtgcyagatgaactattctgtttacctttgtgtttgtttcaaactatccatgggaaaagaatttttaaaaatagcacccacagcatatgatcagacatatccctg

SEQ ID NO: 112407 - DNA, 201 bp, Bos taurus; identical to SEQ ID NO: 71115

SEQ ID NO: 112408 - DNA, 201 bp, Bos taurus
ctctacacagcaattttgggttcttacctaagactttgaccaaggtaatcccagaatcacctgagacctagcaaattctttaaatcctactatacacacayacacgcccacacaaagccccccccacacgtatacctgtgtgtgcccgttcatgtgtgggtagacaatgctttcattcctaaatttaaagcatttttctct

SEQ ID NO: 112409 - DNA, 201 bp, Bos taurus; identical to SEQ ID NO: 71116

SEQ ID NO: 112410 - DNA, 201 bp, Bos taurus; identical to SEQ ID NO: 71117

SEQ ID NO: 112411 - DNA, 201 bp, Bos taurus; identical to SEQ ID NO: 71118

SEQ ID NO: 112412 - DNA, 201 bp, Bos taurus; identical to SEQ ID NO: 71119

SEQ ID NO: 112413 - DNA, 201 bp, Bos taurus; identical to SEQ ID NO: 31487

SEQ ID NO: 112414 - DNA, 201 bp, Bos taurus; identical to SEQ ID NO: 31488

SEQ ID NO: 112415 - DNA, 201 bp, Bos taurus
gctgtctcttggctcatctccccctttctctgtccctgacacggccacactacctgataccctctcatcaccaggcccctggactgcccttacacaagggygcagccagcctccagtcgaccgtgctgtgatcgaacacttgcaacaccatactgaccttcaggccctgttgtaccaggtcagggagtacccacgctgttg

SEQ ID NO: 112416 - DNA, 201 bp, Bos taurus
gttaccagtagtctttggaccaaggatacctgaggctgagagcagtttatctacatgaaatgttggcataaatctgtaaacttgacaagttagcattttcmtgtcctattacttggcctaagggttttgtttttggtggtgcagtctctctatattttgctggtttatcaggaccttcctcttagtagaaggagtaatgtt

SEQ ID NO: 112417 - DNA, 201 bp, Bos taurus
tctgctgatctaattgggtgaagacagagctgaaaagcgcccaaggcttcgggctgttattaaccagcggggcacattctctgtttcctgggcctcctacrctcacatgaattatctccaggatgctataaagagtaggaaagctagataaaaattatagttcaataaatcctgccacaaaagggattagcaaagcatctc

SEQ ID NO: 112418 - DNA, 201 bp, Bos taurus; identical to SEQ ID NO: 71129

SEQ ID NO: 112419 - DNA, 201 bp, Bos taurus
acttaagacgagggttaccttgaagatagtggcggagaccactctgcagaggtgatacatcatctgagatttgacaccaaatgaaccaaatgaaccaagayggagatgctttcctaggcagaagcagagcacagttgaaggctctgagatgggaactggaaatgtataatttcttcttatacattaagtagtaatttaaaa

SEQ ID NO: 112420 - DNA, 201 bp, Bos taurus; identical to SEQ ID NO: 71130

SEQ ID NO: 112421 - DNA, 201 bp, Bos taurus
caccagactcctctgtccatagaattctctaggcaagaggactgaggttgggtagccgttcccttctcccagggatcttctcgacccaaggatggaacccrtgtcatctgcatccgttatcaagacttccttcatgtaccttaaaaaagattcacccatctagaatccagctcgggtacagtggctcaaagtatagagact

SEQ ID NO: 112422 - DNA, 201 bp, Bos taurus; identical to SEQ ID NO: 71133

SEQ ID NO: 112423 - DNA, 201 bp, Bos taurus
cagccaaaaaaaaaaaaaaaaaatacgtagtgagcatctcctagatgtcaggtacagttcagaggacgcagtgtgaacacagtcagtaactggcccctcayagagcttaccttctagtgtggaagaagaggtagctttataatggtgtccaaataaaaacagaaacacggggacttcccaggcagtccaataggttgagac

SEQ ID NO: 112424 - DNA, 201 bp, Bos taurus; identical to SEQ ID NO: 31500

SEQ ID NO: 112425 - DNA, 201 bp, Bos taurus; identical to SEQ ID NO: 71140

SEQ ID NO: 112426 - DNA, 201 bp, Bos taurus; identical to SEQ ID NO: 71141

SEQ ID NO: 112427 - DNA, 201 bp, Bos taurus; identical to SEQ ID NO: 31501

SEQ ID NO: 112428 - DNA, 201 bp, Bos taurus; identical to SEQ ID NO: 31502

SEQ ID NO: 112429 - DNA, 201 bp, Bos taurus; identical to SEQ ID NO: 31503

SEQ ID NO: 112430 - DNA, 201 bp, Bos taurus
ataccgggcttcctcacttgttagtaaggataattgcaaggattgtagaagtattgtaaggattaaataatacaagacagcaaagcctcccatctactgartgcaaagtcacctgtcactgtggcataatgctgacaaactgatactgctcacagtcaggggtggagtcagacctggcaccttcctagcctagtccatgct

SEQ ID NO: 112431 - DNA, 201 bp, Bos taurus; identical to SEQ ID NO: 71143

SEQ ID NO: 112432 - DNA, 201 bp, Bos taurus; identical to SEQ ID NO: 71145

SEQ ID NO: 112433 - DNA, 201 bp, Bos taurus; identical to SEQ ID NO: 31505

SEQ ID NO: 112434 - DNA, 201 bp, Bos taurus; identical to SEQ ID NO: 31509

SEQ ID NO: 112435 - DNA, 201 bp, Bos taurus; identical to SEQ ID NO: 31510

SEQ ID NO: 112436 - DNA, 201 bp, Bos taurus; identical to SEQ ID NO: 31511

SEQ ID NO: 112437 - DNA, 201 bp, Bos taurus; identical to SEQ ID NO: 31512

SEQ ID NO: 112438 - DNA, 201 bp, Bos taurus; identical to SEQ ID NO: 31513

SEQ ID NO: 112439 - DNA, 201 bp, Bos taurus
cctgagaaccacactgggtacattctcatgaaaggtgtgaaaatctgattttctaaaatggatcagtaattctctatgaagggggaaggatcgataaatcwttgctaagtagattgtaaaggaaaaattattctttcagtgacagtacattaggatcctccaaacaatctcaataaagtaaagacataacatctctctacc

SEQ ID NO: 112440 - DNA, 201 bp, Bos taurus; identical to SEQ ID NO: 31516

SEQ ID NO: 112441 - DNA, 201 bp, Bos taurus
cagcagtgagccacctgggaagccccctggtgcctgcacatttctgtaaaacatgagcagtgccctctgagcaatgagcagcatggtggtagtggggcctkcatgtatttgctatgtcaagaacacattttatcagactacctcagagtagataatatccccttgacattacattctacgatgtgctattcttggaaccca

SEQ ID NO: 112442 - DNA, 201 bp, Bos taurus
tagactttcatcccagctcctcaactgctaatagctacagccctgggatcacattattaaagtgtagttcatctgtactacaatttccgtgaaatagaccrtctgcgggtaccaacaacatcacattacagacattttactactatggttagtggttaagtaccatttttttcccctcttgagagcagacctttaagaata

SEQ ID NO: 112443 - DNA, 201 bp, Bos taurus; identical to SEQ ID NO: 31519

SEQ ID NO: 112444 - DNA, 201 bp, Bos taurus; identical to SEQ ID NO: 31520

SEQ ID NO: 112445 - DNA, 201 bp, Bos taurus; identical to SEQ ID NO: 31521

SEQ ID NO: 112446 - DNA, 201 bp, Bos taurus; identical to SEQ ID NO: 31522

SEQ ID NO: 112447 - DNA, 201 bp, Bos taurus; identical to SEQ ID NO: 31523

SEQ ID NO: 112448 - DNA, 201 bp, Bos taurus; identical to SEQ ID NO: 31524

SEQ ID NO: 112449 - DNA, 201 bp, Bos taurus; identical to SEQ ID NO: 31525

SEQ ID NO: 112450 - DNA, 201 bp, Bos taurus; identical to SEQ ID NO: 31526

SEQ ID NO: 112451 - DNA, 201 bp, Bos taurus; identical to SEQ ID NO: 31527

SEQ ID NO: 112452 - DNA, 201 bp, Bos taurus; identical to SEQ ID NO: 31528

SEQ ID NO: 112453 - DNA, 201 bp, Bos taurus; identical to SEQ ID NO: 31529

SEQ ID NO: 112454 - DNA, 201 bp, Bos taurus; identical to SEQ ID NO: 31530

SEQ ID NO: 112455 - DNA, 201 bp, Bos taurus; identical to SEQ ID NO: 31531

SEQ ID NO: 112456 - DNA, 201 bp, Bos taurus; identical to SEQ ID NO: 31532

SEQ ID NO: 112457 - DNA, 201 bp, Bos taurus; identical to SEQ ID NO: 31533

SEQ ID NO: 112458 - DNA, 201 bp, Bos taurus; identical to SEQ ID NO: 31534

SEQ ID NO: 112459 - DNA, 201 bp, Bos taurus; identical to SEQ ID NO: 31535

SEQ ID NO: 112460 - DNA, 201 bp, Bos taurus; identical to SEQ ID NO: 31536

SEQ ID NO: 112461 - DNA, 201 bp, Bos taurus; identical to SEQ ID NO: 31537

SEQ ID NO: 112462 - DNA, 201 bp, Bos taurus; identical to SEQ ID NO: 31538

SEQ ID NO: 112463 - DNA, 201 bp, Bos taurus; identical to SEQ ID NO: 31543

SEQ ID NO: 112464 - DNA, 201 bp, Bos taurus; identical to SEQ ID NO: 31544

SEQ ID NO: 112465 - DNA, 201 bp, Bos taurus; identical to SEQ ID NO: 31545

SEQ ID NO: 112466 - DNA, 201 bp, Bos taurus
aaaagatagcaagttcttattagttttacttttttccttttctccttttgtgcagtaggtaaaactaccaaaaggaaaaaaagaaggagtgtccatgcctsgaattcatctctttcagtgctatcagtgtagagttttcactgaagcccagggaggctgacaaatcacactcctgagccgcggttgttagccctttctctt

SEQ ID NO: 112467 - DNA, 201 bp, Bos taurus
tactggagtgggctgccattgccttctctgaatttagtgtttaaaacaatgcaaatttactttcttacagttttcaaggcctaaagtctgaaatgagcaayatgcggttaaaatcaatgtgctgtgctcttctgaaggctctagggcacaatttgttcccttgtcttttccagcttccagagtaggcctacatctcttggc

SEQ ID NO: 112468 - DNA, 201 bp, Bos taurus; identical to SEQ ID NO: 31546

SEQ ID NO: 112469 - DNA, 201 bp, Bos taurus; identical to SEQ ID NO: 31547

SEQ ID NO: 112470 - DNA, 201 bp, Bos taurus; identical to SEQ ID NO: 31549

SEQ ID NO: 112471 - DNA, 201 bp, Bos taurus; identical to SEQ ID NO: 31550

SEQ ID NO: 112472 - DNA, 201 bp, Bos taurus
ggagtgggacctggcccactttaacaatccaactgaaaagacatatgggaaaaagatggctttggggcagtcttgatttttttttttccccaggcttctcrgagaaagaagactctaagaggccacacttaagcccctgccaactttagcatgaacaaccaaatgtctttggaattgaagtgaccttactcaaccttgtgg

SEQ ID NO: 112473 - DNA, 201 bp, Bos taurus
gagtgatactcatcatagcagcaggtgttgcggtatgtgccctggcccatgagaatagacatctaattattcaaacaagcattgggctctgcaccttaccratgcattccaaataaatatcggccttatcctagacatgcagagagctagcctttataaccctcatccattaaatttcagtagcatttgcaatcattgtga

SEQ ID NO: 112474 - DNA, 201 bp, Bos taurus; identical to SEQ ID NO: 71186

SEQ ID NO: 112475 - DNA, 201 bp, Bos taurus; identical to SEQ ID NO: 31551

SEQ ID NO: 112476 - DNA, 201 bp, Bos taurus; identical to SEQ ID NO: 31552

SEQ ID NO: 112477 - DNA, 201 bp, Bos taurus; identical to SEQ ID NO: 31553

SEQ ID NO: 112478 - DNA, 201 bp, Bos taurus; identical to SEQ ID NO: 31554

SEQ ID NO: 112479 - DNA, 201 bp, Bos taurus; identical to SEQ ID NO: 31555

SEQ ID NO: 112480 - DNA, 201 bp, Bos taurus; identical to SEQ ID NO: 31556

SEQ ID NO: 112481 - DNA, 201 bp, Bos taurus; identical to SEQ ID NO: 31557

SEQ ID NO: 112482 - DNA, 201 bp, Bos taurus; identical to SEQ ID NO: 31558

SEQ ID NO: 112483 - DNA, 201 bp, Bos taurus; identical to SEQ ID NO: 31559

SEQ ID NO: 112484 - DNA, 201 bp, Bos taurus; identical to SEQ ID NO: 31560

SEQ ID NO: 112485 - DNA, 201 bp, Bos taurus; identical to SEQ ID NO: 31561

SEQ ID NO: 112486 - DNA, 201 bp, Bos taurus; identical to SEQ ID NO: 31562

SEQ ID NO: 112487 - DNA, 201 bp, Bos taurus; identical to SEQ ID NO: 31563

SEQ ID NO: 112488 - DNA, 201 bp, Bos taurus
aagagttggacacaacttagtgactaagcacaatcaatattgatatgagcttccctcttagcttggttggtaaagaatgtgcctgcaatgggcttccctcrtgcctcagttggtaaagaatctggctgcagtgcatgagacctaggttcaattcctgggtcgggaatatcccctggagaaggaaatggcaatccactccag

SEQ ID NO: 112489 - DNA, 201 bp, Bos taurus; identical to SEQ ID NO: 31566

SEQ ID NO: 112490 - DNA, 201 bp, Bos taurus; identical to SEQ ID NO: 31570

SEQ ID NO: 112491 - DNA, 201 bp, Bos taurus; identical to SEQ ID NO: 31572

SEQ ID NO: 112492 - DNA, 201 bp, Bos taurus
cactgacttaggattgatagtgagaaaagaattcttcactgaaaaagtcattagctttctcgcaggttagaaaaaaatggaataaataagaaattatggaygaagaggccacatgggttgagtctcagtttttgctgtatcttgcccatatttgacagaattttaaaccatgatttaccataaagttagcaaaacttaaaa

SEQ ID NO: 112493 - DNA, 201 bp, Bos taurus; identical to SEQ ID NO: 31575

SEQ ID NO: 112494 - DNA, 201 bp, Bos taurus; identical to SEQ ID NO: 31578

SEQ ID NO: 112495 - DNA, 201 bp, Bos taurus
cactgaacttattttatactttattaaaattatgtggccccagagaggtgtccctaatgagattttataatttcctcttgaaatgctaaaactagcacatraattcatggcccaggagtcttgagagtatggagaaggaaatctgcaggtagaaacaacactggggagtctgaaatctttttataatttcttagcatcatt

SEQ ID NO: 112496 - DNA, 201 bp, Bos taurus; identical to SEQ ID NO: 31579

SEQ ID NO: 112497 - DNA, 201 bp, Bos taurus; identical to SEQ ID NO: 31580

SEQ ID NO: 112498 - DNA, 201 bp, Bos taurus; identical to SEQ ID NO: 31581

SEQ ID NO: 112499 - DNA, 201 bp, Bos taurus; identical to SEQ ID NO: 31582

SEQ ID NO: 112500 - DNA, 201 bp, Bos taurus; identical to SEQ ID NO: 31584

SEQ ID NO: 112501 - DNA, 201 bp, Bos taurus; identical to SEQ ID NO: 31585

SEQ ID NO: 112502 - DNA, 201 bp, Bos taurus; identical to SEQ ID NO: 71216

SEQ ID NO: 112503 - DNA, 201 bp, Bos taurus; identical to SEQ ID NO: 71217

SEQ ID NO: 112504 - DNA, 201 bp, Bos taurus; identical to SEQ ID NO: 71218

SEQ ID NO: 112505 - DNA, 201 bp, Bos taurus; identical to SEQ ID NO: 71219

SEQ ID NO: 112506 - DNA, 201 bp, Bos taurus
aagctactacagctgcaatagccaatttcattgtatgaatataaaataaactgtaaattataaattcaaagtatctcctatatgaaagcaatccacccackgacaaggactagaaatctctaaagaagtttttgtaagtggtaacaatgaataatttagtttagattcctattcctatcacccatatattgggaagttgaa

SEQ ID NO: 112507 - DNA, 201 bp, Bos taurus
gtaaactccgcgagttggtgatagatagggaggcctggtgtgctgcgtccatggggtcacaaacagtcggacaggactgagcgactaaactgaactgaacrgaagagaccaggaaggcctccacggaaatattatgggttaaatcggaaacaggctctgtgggcaaagaatccacatgtaatgcaggaaacacaggtgatg

SEQ ID NO: 112508 - DNA, 201 bp, Bos taurus
aaaaacctaaggtttatagacatgaaacaactggcctagagtcgcaaaattaataagtgacaaattaccagattcctcaattcaagtccaaagttctcacyacaaatggccttagaatacggcaaaatggctatgctttcagaagtgtatttaaatactgttacaagacctggtaaaatgagagaatcataccaagaacag

SEQ ID NO: 112509 - DNA, 201 bp, Bos taurus
catgaatgaaagaggctggtcaccttataagtttttctaggtccagaaagagttctaaaaatatacaagtgaagtcagaaactggctacctgtctctagamggtgggcctcaataagcttgacctaccagaggcttttcttttcttcctgtgacctgaggcctcttaaagttaagtgcaaatcaggcagctagaattttgt

SEQ ID NO: 112510 - DNA, 201 bp, Bos taurus; identical to SEQ ID NO: 31590

SEQ ID NO: 112511 - DNA, 201 bp, Bos taurus; identical to SEQ ID NO: 31594

SEQ ID NO: 112512 - DNA, 201 bp, Bos taurus; identical to SEQ ID NO: 31595

SEQ ID NO: 112513 - DNA, 201 bp, Bos taurus; identical to SEQ ID NO: 71233

SEQ ID NO: 112514 - DNA, 201 bp, Bos taurus
gagtagtgccaagttggcactgccttctctctgccaggcttcttgatctgttgtttagtttcttcgtggatcagcatctttggccatcaggctgcctcacrcaactcattaattgtttccagttttatgctgtcagcttcagctatagctcggcttctcttccttgcagctggtatggcctcggctcatcatccagtactg

SEQ ID NO: 112515 - DNA, 201 bp, Bos taurus; identical to SEQ ID NO: 31605

SEQ ID NO: 112516 - DNA, 201 bp, Bos taurus; identical to SEQ ID NO: 71238

SEQ ID NO: 112517 - DNA, 201 bp, Bos taurus; identical to SEQ ID NO: 31607

SEQ ID NO: 112518 - DNA, 201 bp, Bos taurus; identical to SEQ ID NO: 31608

SEQ ID NO: 112519 - DNA, 201 bp, Bos taurus
aaaacatgaaaatgtaaagcgctgtgacaatttggagacttacagagttaggtattatttcatcaagtcccgaatctaatattatttccccagtgaggccktactagatctcactggtgttgaactgtgttcctgcagctctttgattgttattgtcttctctcttgctactgcactttagaccttccaaggtggaggcca

SEQ ID NO: 112520 - DNA, 201 bp, Bos taurus; identical to SEQ ID NO: 71240

SEQ ID NO: 112521 - DNA, 201 bp, Bos taurus; identical to SEQ ID NO: 71241

SEQ ID NO: 112522 - DNA, 201 bp, Bos taurus; identical to SEQ ID NO: 71243

SEQ ID NO: 112523 - DNA, 201 bp, Bos taurus
tctgtacgctggctgttccccctccggagtggtggcggtgaggagagaaggtaaatgggccaagtctgaatgattcggtgcagggccagggaaaagtattrtttatattttcaaaggattgttttaaaaaaaagaaaagaaaagaaaagaagagtatgtgacagagaccgtatgtgaccaaatctgggccttaacagaaaa

SEQ ID NO: 112524 - DNA, 201 bp, Bos taurus
ttccccacaacagcagagtggtcactgaacctgtttaaaacactgcaatgatcttttccattacattaaaaatataactcaaccctttaatctggcctacraagtcctaatagggcctcgccctgcctacaatttggaccctttctcgtatctcgctctctacccagccttccagcctcatctctcttccctgagcatgcc

SEQ ID NO: 112525 - DNA, 201 bp, Bos taurus; identical to SEQ ID NO: 71246

SEQ ID NO: 112526 - DNA, 201 bp, Bos taurus; identical to SEQ ID NO: 31613

SEQ ID NO: 112527 - DNA, 201 bp, Bos taurus
gacattattactcagataaaagattaagctagacgctttacagtaagtcttaaattttataaaaaggataacttggaaagctctgtcagtctgtccctgcragggcgaacagagctttaagaatggagcttctgctactgtagcttctcccggactctataatggagacaaacaatcctagtttcagatatgttatcaagt

SEQ ID NO: 112528 - DNA, 201 bp, Bos taurus; identical to SEQ ID NO: 71248

SEQ ID NO: 112529 - DNA, 201 bp, Bos taurus
tctgatctgatctctccttcacacttcctcctgacctaggcaaaagctgtgcccttgttcctctcatctttctcagcaatacagaaaaagttctctttgtyggccacttatctgcagccccaaacaagtcatcttgccccttatccacacagagcataatacgataatatgaacagaatcctagcagctatgctgcccctc

SEQ ID NO: 112530 - DNA, 201 bp, Bos taurus
tgttccttgagctctcttactgtacaaggtcaaacagaatcttaagccaacattttcaaaacctcttcattccattcttaaagatatccatcaatggatamtttgcgtctgttcaattaaaactaccacagcccctgtaactgttgagaaaaaccctttgtgctttgccaaagacaccagccagaaacgaccatcaggaca

SEQ ID NO: 112531 - DNA, 201 bp, Bos taurus
actactaaaaagaccctccaaatatcatgccgttactatgacaacttcaaaaatgctttgagaaaatgtcagggattttaagattcatgataaaacaagcrtcatctagtctgccagaaattactttcatttatatcaggcagcaaaaaggctaaatggctatttacaactgtgaactatcaaatcattaccttttgagag

SEQ ID NO: 112532 - DNA, 201 bp, Bos taurus
atcccaatatattgtttgtaaaactctgaaaggaccaactggaatcactggttctattaaggaaacaaactactaaccaacacctattaagaaggacaaargtacacagagcctgcgacaagatttaaaggagcaaaacacccctcgcacagcaaggcagatggcagagcaagggcaggctcattcaagctgctcctgcag

SEQ ID NO: 112533 - DNA, 201 bp, Bos taurus; identical to SEQ ID NO: 31616

SEQ ID NO: 112534 - DNA, 201 bp, Bos taurus; identical to SEQ ID NO: 31617

SEQ ID NO: 112535 - DNA, 201 bp, Bos taurus; identical to SEQ ID NO: 31618

SEQ ID NO: 112536 - DNA, 201 bp, Bos taurus; identical to SEQ ID NO: 31619

SEQ ID NO: 112537 - DNA, 201 bp, Bos taurus; identical to SEQ ID NO: 71256

SEQ ID NO: 112538 - DNA, 201 bp, Bos taurus; identical to SEQ ID NO: 71257

SEQ ID NO: 112539 - DNA, 201 bp, Bos taurus; identical to SEQ ID NO: 31620

SEQ ID NO: 112540 - DNA, 201 bp, Bos taurus; identical to SEQ ID NO: 31621

SEQ ID NO: 112541 - DNA, 201 bp, Bos taurus; identical to SEQ ID NO: 31625

SEQ ID NO: 112542 - DNA, 201 bp, Bos taurus; identical to SEQ ID NO: 31627

SEQ ID NO: 112543 - DNA, 201 bp, Bos taurus; identical to SEQ ID NO: 31628

SEQ ID NO: 112544 - DNA, 201 bp, Bos taurus; identical to SEQ ID NO: 31629

SEQ ID NO: 112545 - DNA, 201 bp, Bos taurus; identical to SEQ ID NO: 71261

SEQ ID NO: 112546 - DNA, 201 bp, Bos taurus; identical to SEQ ID NO: 71262

SEQ ID NO: 112547 - DNA, 201 bp, Bos taurus; identical to SEQ ID NO: 71264

SEQ ID NO: 112548 - DNA, 201 bp, Bos taurus; identical to SEQ ID NO: 31631

SEQ ID NO: 112549 - DNA, 201 bp, Bos taurus; identical to SEQ ID NO: 31633

SEQ ID NO: 112550 - DNA, 201 bp, Bos taurus; identical to SEQ ID NO: 31634

SEQ ID NO: 112551 - DNA, 201 bp, Bos taurus
agaggccaaaacaaacagggccttcgccaagacagtagtcctcaggtctacttccccacctcccataacacacatgatgaatgaggttcacacattgaacscttgcgagggccacaaaaaagaataatgtcatttgcagcaacatggatggaccaagaggtcaccatactaagcgaagttaagtcagaaagagacagacag

SEQ ID NO: 112552 - DNA, 201 bp, Bos taurus; identical to SEQ ID NO: 71267

SEQ ID NO: 112553 - DNA, 201 bp, Bos taurus; identical to SEQ ID NO: 31635

SEQ ID NO: 112554 - DNA, 201 bp, Bos taurus; identical to SEQ ID NO: 31636

SEQ ID NO: 112555 - DNA, 201 bp, Bos taurus; identical to SEQ ID NO: 31637

SEQ ID NO: 112556 - DNA, 201 bp, Bos taurus
gagggtgtatagccaagaggttgaggtttgttctttggggttcaccacctggctttgaatcccaacctgaccctcccttcactaactctattttttcagtkaaatggaaataaaaattatacttttgtttaaggcatgtcattaaatttaaatgagatgataacacatgtaaaatgcacataataatcttggccattatta

SEQ ID NO: 112557 - DNA, 201 bp, Bos taurus; identical to SEQ ID NO: 71271

SEQ ID NO: 112558 - DNA, 201 bp, Bos taurus; identical to SEQ ID NO: 71272

SEQ ID NO: 112559 - DNA, 201 bp, Bos taurus
ggaggagtgctggctggctgccaggcagccaccaactcggggtcagaagggcactgagtctatggagccccgcacctgctttggccacggggacctgcggraatgaggcaggagtgcagaaaccatgctgggatagctggtggtgtggggggtgccaggtggccccaacagcacacaaccagggttccagggacccagggc

SEQ ID NO: 112560 - DNA, 201 bp, Bos taurus; identical to SEQ ID NO: 71277

SEQ ID NO: 112561 - DNA, 201 bp, Bos taurus; identical to SEQ ID NO: 31641

SEQ ID NO: 112562 - DNA, 201 bp, Bos taurus; identical to SEQ ID NO: 71278

SEQ ID NO: 112563 - DNA, 201 bp, Bos taurus; identical to SEQ ID NO: 71280

SEQ ID NO: 112564 - DNA, 201 bp, Bos taurus; identical to SEQ ID NO: 31644

SEQ ID NO: 112565 - DNA, 201 bp, Bos taurus; identical to SEQ ID NO: 31645

SEQ ID NO: 112566 - DNA, 201 bp, Bos taurus; identical to SEQ ID NO: 31646

SEQ ID NO: 112567 - DNA, 201 bp, Bos taurus; identical to SEQ ID NO: 31647

SEQ ID NO: 112568 - DNA, 201 bp, Bos taurus; identical to SEQ ID NO: 31650

SEQ ID NO: 112569 - DNA, 201 bp, Bos taurus; identical to SEQ ID NO: 31651

SEQ ID NO: 112570 - DNA, 201 bp, Bos taurus; identical to SEQ ID NO: 31652

SEQ ID NO: 112571 - DNA, 201 bp, Bos taurus; identical to SEQ ID NO: 31657

SEQ ID NO: 112572 - DNA, 201 bp, Bos taurus; identical to SEQ ID NO: 71293

SEQ ID NO: 112573 - DNA, 201 bp, Bos taurus; identical to SEQ ID NO: 31662

SEQ ID NO: 112574 - DNA, 201 bp, Bos taurus; identical to SEQ ID NO: 31663

SEQ ID NO: 112575 - DNA, 201 bp, Bos taurus; identical to SEQ ID NO: 71296

SEQ ID NO: 112576 - DNA, 201 bp, Bos taurus; identical to SEQ ID NO: 31667

SEQ ID NO: 112577 - DNA, 201 bp, Bos taurus; identical to SEQ ID NO: 31668

SEQ ID NO: 112578 - DNA, 201 bp, Bos taurus; identical to SEQ ID NO: 31669

SEQ ID NO: 112579 - DNA, 201 bp, Bos taurus; identical to SEQ ID NO: 31670

SEQ ID NO: 112580 - DNA, 201 bp, Bos taurus; identical to SEQ ID NO: 31671

SEQ ID NO: 112581 - DNA, 201 bp, Bos taurus; identical to SEQ ID NO: 71300

SEQ ID NO: 112582 - DNA, 201 bp, Bos taurus; identical to SEQ ID NO: 71301

SEQ ID NO: 112583 - DNA, 201 bp, Bos taurus; identical to SEQ ID NO: 31673

SEQ ID NO: 112584 - DNA, 201 bp, Bos taurus; identical to SEQ ID NO: 31674

SEQ ID NO: 112585 - DNA, 201 bp, Bos taurus; identical to SEQ ID NO: 71304

SEQ ID NO: 112586 - DNA, 201 bp, Bos taurus; identical to SEQ ID NO: 31676

SEQ ID NO: 112587 - DNA, 201 bp, Bos taurus; identical to SEQ ID NO: 71305

SEQ ID NO: 112588 - DNA, 201 bp, Bos taurus; identical to SEQ ID NO: 31679

SEQ ID NO: 112589 - DNA, 201 bp, Bos taurus; identical to SEQ ID NO: 71308

SEQ ID NO: 112590 - DNA, 201 bp, Bos taurus; identical to SEQ ID NO: 71309

SEQ ID NO: 112591 - DNA, 201 bp, Bos taurus; identical to SEQ ID NO: 31680

SEQ ID NO: 112592 - DNA, 201 bp, Bos taurus; identical to SEQ ID NO: 31682

SEQ ID NO: 112593 - DNA, 201 bp, Bos taurus; identical to SEQ ID NO: 31683

SEQ ID NO: 112594 - DNA, 201 bp, Bos taurus; identical to SEQ ID NO: 31684

SEQ ID NO: 112595 - DNA, 201 bp, Bos taurus; identical to SEQ ID NO: 31686

SEQ ID NO: 112596 - DNA, 201 bp, Bos taurus; identical to SEQ ID NO: 31687

SEQ ID NO: 112597 - DNA, 201 bp, Bos taurus; identical to SEQ ID NO: 31688

SEQ ID NO: 112598 - DNA, 201 bp, Bos taurus; identical to SEQ ID NO: 31689

SEQ ID NO: 112599 - DNA, 201 bp, Bos taurus; identical to SEQ ID NO: 31690

SEQ ID NO: 112600 - DNA, 201 bp, Bos taurus; identical to SEQ ID NO: 31691

SEQ ID NO: 112601 - DNA, 201 bp, Bos taurus; identical to SEQ ID NO: 71313

SEQ ID NO: 112602 - DNA, 201 bp, Bos taurus; identical to SEQ ID NO: 31695

SEQ ID NO: 112603 - DNA, 201 bp, Bos taurus; identical to SEQ ID NO: 71315

SEQ ID NO: 112604 - DNA, 201 bp, Bos taurus; identical to SEQ ID NO: 71316

SEQ ID NO: 112605 - DNA, 201 bp, Bos taurus; identical to SEQ ID NO: 31697

SEQ ID NO: 112606 - DNA, 201 bp, Bos taurus; identical to SEQ ID NO: 71318

SEQ ID NO: 112607 - DNA, 201 bp, Bos taurus; identical to SEQ ID NO: 71319

SEQ ID NO: 112608 - DNA, 201 bp, Bos taurus; identical to SEQ ID NO: 31699

SEQ ID NO: 112609 - DNA, 201 bp, Bos taurus; identical to SEQ ID NO: 31700

SEQ ID NO: 112610 - DNA, 201 bp, Bos taurus; identical to SEQ ID NO: 31703

SEQ ID NO: 112611 - DNA, 201 bp, Bos taurus; identical to SEQ ID NO: 71323

SEQ ID NO: 112612 - DNA, 201 bp, Bos taurus; identical to SEQ ID NO: 71324

SEQ ID NO: 112613 - DNA, 201 bp, Bos taurus; identical to SEQ ID NO: 31705

SEQ ID NO: 112614 - DNA, 201 bp, Bos taurus; identical to SEQ ID NO: 31708

SEQ ID NO: 112615 - DNA, 201 bp, Bos taurus; identical to SEQ ID NO: 71329

SEQ ID NO: 112616 - DNA, 201 bp, Bos taurus; identical to SEQ ID NO: 31712

SEQ ID NO: 112617 - DNA, 201 bp, Bos taurus; identical to SEQ ID NO: 31716

SEQ ID NO: 112618 - DNA, 201 bp, Bos taurus; identical to SEQ ID NO: 31717

SEQ ID NO: 112619 - DNA, 201 bp, Bos taurus; identical to SEQ ID NO: 31720

SEQ ID NO: 112620 - DNA, 201 bp, Bos taurus; identical to SEQ ID NO: 71336

SEQ ID NO: 112621 - DNA, 201 bp, Bos taurus; identical to SEQ ID NO: 71338

SEQ ID NO: 112622 - DNA, 201 bp, Bos taurus; identical to SEQ ID NO: 31723

SEQ ID NO: 112623 - DNA, 201 bp, Bos taurus; identical to SEQ ID NO: 31730

SEQ ID NO: 112624 - DNA, 201 bp, Bos taurus; identical to SEQ ID NO: 71346

SEQ ID NO: 112625 - DNA, 201 bp, Bos taurus; identical to SEQ ID NO: 31734

SEQ ID NO: 112626 - DNA, 201 bp, Bos taurus; identical to SEQ ID NO: 31735

SEQ ID NO: 112627 - DNA, 201 bp, Bos taurus; identical to SEQ ID NO: 71351

SEQ ID NO: 112628 - DNA, 201 bp, Bos taurus; identical to SEQ ID NO: 71352

SEQ ID NO: 112629 - DNA, 201 bp, Bos taurus; identical to SEQ ID NO: 71354

SEQ ID NO: 112630 - DNA, 201 bp, Bos taurus; identical to SEQ ID NO: 31741

SEQ ID NO: 112631 - DNA, 201 bp, Bos taurus; identical to SEQ ID NO: 71356

SEQ ID NO: 112632 - DNA, 201 bp, Bos taurus; identical to SEQ ID NO: 31744

SEQ ID NO: 112633 - DNA, 201 bp, Bos taurus; identical to SEQ ID NO: 71359

SEQ ID NO: 112634 - DNA, 201 bp, Bos taurus; identical to SEQ ID NO: 31745

SEQ ID NO: 112635 - DNA, 201 bp, Bos taurus; identical to SEQ ID NO: 71360

SEQ ID NO: 112636 - DNA, 201 bp, Bos taurus; identical to SEQ ID NO: 71365

SEQ ID NO: 112637 - DNA, 201 bp, Bos taurus; identical to SEQ ID NO: 71366

SEQ ID NO: 112638 - DNA, 201 bp, Bos taurus; identical to SEQ ID NO: 31751

SEQ ID NO: 112639 - DNA, 201 bp, Bos taurus; identical to SEQ ID NO: 71370

SEQ ID NO: 112640 - DNA, 201 bp, Bos taurus; identical to SEQ ID NO: 71371

SEQ ID NO: 112641 - DNA, 201 bp, Bos taurus; identical to SEQ ID NO: 71372

SEQ ID NO: 112642 - DNA, 201 bp, Bos taurus; identical to SEQ ID NO: 71373

SEQ ID NO: 112643 - DNA, 201 bp, Bos taurus; identical to SEQ ID NO: 71374

SEQ ID NO: 112644 - DNA, 201 bp, Bos taurus; identical to SEQ ID NO: 71375

SEQ ID NO: 112645 - DNA, 201 bp, Bos taurus; identical to SEQ ID NO: 71376

SEQ ID NO: 112646 - DNA, 201 bp, Bos taurus; identical to SEQ ID NO: 71377

SEQ ID NO: 112647 - DNA, 201 bp, Bos taurus; identical to SEQ ID NO: 71379

SEQ ID NO: 112648 - DNA, 201 bp, Bos taurus; identical to SEQ ID NO: 71380

SEQ ID NO: 112649 - DNA, 201 bp, Bos taurus; identical to SEQ ID NO: 31755

SEQ ID NO: 112650 - DNA, 201 bp, Bos taurus; identical to SEQ ID NO: 71382

SEQ ID NO: 112651 - DNA, 201 bp, Bos taurus; identical to SEQ ID NO: 31757

SEQ ID NO: 112652 - DNA, 201 bp, Bos taurus; identical to SEQ ID NO: 71383

SEQ ID NO: 112653 - DNA, 201 bp, Bos taurus; identical to SEQ ID NO: 71384

SEQ ID NO: 112654 - DNA, 201 bp, Bos taurus; identical to SEQ ID NO: 71386

SEQ ID NO: 112655 - DNA, 201 bp, Bos taurus; identical to SEQ ID NO: 71388

SEQ ID NO: 112656 - DNA, 201 bp, Bos taurus; identical to SEQ ID NO: 71389

SEQ ID NO: 112657 - DNA, 201 bp, Bos taurus; identical to SEQ ID NO: 31761

SEQ ID NO: 112658 - DNA, 201 bp, Bos taurus; identical to SEQ ID NO: 71391

SEQ ID NO: 112659 - DNA, 201 bp, Bos taurus; identical to SEQ ID NO: 71392

SEQ ID NO: 112660 - DNA, 201 bp, Bos taurus; identical to SEQ ID NO: 31762

SEQ ID NO: 112661 - DNA, 201 bp, Bos taurus; identical to SEQ ID NO: 71393

SEQ ID NO: 112662 - DNA, 201 bp, Bos taurus; identical to SEQ ID NO: 31763

SEQ ID NO: 112663 - DNA, 201 bp, Bos taurus; identical to SEQ ID NO: 31764

SEQ ID NO: 112664 - DNA, 201 bp, Bos taurus; identical to SEQ ID NO: 71394

SEQ ID NO: 112665 - DNA, 201 bp, Bos taurus; identical to SEQ ID NO: 31765

SEQ ID NO: 112666 - DNA, 201 bp, Bos taurus; identical to SEQ ID NO: 31772

SEQ ID NO: 112667 - DNA, 201 bp, Bos taurus; identical to SEQ ID NO: 71402

SEQ ID NO: 112668 - DNA, 201 bp, Bos taurus; identical to SEQ ID NO: 71404

SEQ ID NO: 112669 - DNA, 201 bp, Bos taurus; identical to SEQ ID NO: 71405

SEQ ID NO: 112670 - DNA, 201 bp, Bos taurus; identical to SEQ ID NO: 71406

SEQ ID NO: 112671 - DNA, 201 bp, Bos taurus; identical to SEQ ID NO: 71410

SEQ ID NO: 112672 - DNA, 201 bp, Bos taurus; identical to SEQ ID NO: 71411

SEQ ID NO: 112673 - DNA, 201 bp, Bos taurus; identical to SEQ ID NO: 31782

SEQ ID NO: 112674 - DNA, 201 bp, Bos taurus; identical to SEQ ID NO: 71418

SEQ ID NO: 112675 - DNA, 201 bp, Bos taurus; identical to SEQ ID NO: 31783

SEQ ID NO: 112676 - DNA, 201 bp, Bos taurus; identical to SEQ ID NO: 31784

SEQ ID NO: 112677 - DNA, 201 bp, Bos taurus
gtcacctgggccgcgcttcgcgccgggatactgcggaaggagaagcccacgctcctgagtttgcgggtcctgaccgcccacagccgacggacgatttcctracggaattctctccgcggccctggagacgagggagcttggataggccgctttgtgcgcgaaggcgggacttcttctcgcccgcgggatcgcggggacccg

SEQ ID NO: 112678 - DNA, 201 bp, Bos taurus; identical to SEQ ID NO: 31787

SEQ ID NO: 112679 - DNA, 201 bp, Bos taurus; identical to SEQ ID NO: 31789

SEQ ID NO: 112680 - DNA, 201 bp, Bos taurus
caactatttagagacagtgtagttcatgaactaagctcatgggctccatagtcgaaagatctgggtttgaataatggttctgctgcctccagttgggcctyagtttgctcaacagtaaaatgtagagaatagtacatatctcaggaaattatcttgaagattaaatgaggaaatacacttccaatacttcgaaaaggatgt

SEQ ID NO: 112681 - DNA, 201 bp, Bos taurus
aaaaattggttttatttgtaaaaccggctggttttatttgtagtattctgtaactcagaggcctctgctatggtatctctcagaacattgcttatctttayttggtgtgaaaggttgttaatgtttttgtgtgtagtgactcagagcatttattttttatggaaggaatgagccactcgaagttattgtattgcagaatga

SEQ ID NO: 112682 - DNA, 201 bp, Bos taurus
acttagatgaacatgagaaaatgaagtgctctgcccaaccacctcttagaaatggctgcagtctggaagaaagctgaatgtcaacctgagatgaaagtttrgctgtatataatatagtgagtacataaaccacaaggaaaccataaggcaactcaagaaaaaaatgtattcaggtggcccaccccatggaccatgcctcat

SEQ ID NO: 112683 - DNA, 201 bp, Bos taurus
gaggttgagcgaatagctaactacatttagagtaagttctactgtaaagaactaaaaggattaatcttttatccaaaattaccagaattactaagctgtayacctaaggtcacattacatagtgcaaaattgaaatttaatcatgattgctagagtattaccctaattgcccaaataaacagaattaaaatcacttggatg

SEQ ID NO: 112684 - DNA, 201 bp, Bos taurus; identical to SEQ ID NO: 31799

SEQ ID NO: 112685 - DNA, 201 bp, Bos taurus
ataagctttctattcttactagaacagagtagtatacaaagaacccaggttacgttcttcgttcgtttgctgaaaagcagtcaaaattctttaattctgtyaaatcagaacactggaaagcacgttgaatactacatgaaataatgactcggtgaacatttgccttctctgcaagtgcgtgccatatgcttgaagaaaaga

SEQ ID NO: 112686 - DNA, 201 bp, Bos taurus; identical to SEQ ID NO: 31800

SEQ ID NO: 112687 - DNA, 201 bp, Bos taurus; identical to SEQ ID NO: 31801

SEQ ID NO: 112688 - DNA, 201 bp, Bos taurus; identical to SEQ ID NO: 31803

SEQ ID NO: 112689 - DNA, 201 bp, Bos taurus; identical to SEQ ID NO: 31804

SEQ ID NO: 112690 - DNA, 201 bp, Bos taurus; identical to SEQ ID NO: 31805

SEQ ID NO: 112691 - DNA, 201 bp, Bos taurus; identical to SEQ ID NO: 31806

SEQ ID NO: 112692 - DNA, 201 bp, Bos taurus; identical to SEQ ID NO: 31807

SEQ ID NO: 112693 - DNA, 201 bp, Bos taurus; identical to SEQ ID NO: 71430

SEQ ID NO: 112694 - DNA, 201 bp, Bos taurus; identical to SEQ ID NO: 31811

SEQ ID NO: 112695 - DNA, 201 bp, Bos taurus; identical to SEQ ID NO: 31812

SEQ ID NO: 112696 - DNA, 201 bp, Bos taurus
ggtaaccaaaaccatcaaagcagagaaaagcacttaggcatttaactctcaactccccatcttggcacgtataaaattatctcacgacattcttttgaaaytgtcttcccttctttttacaaaagctaatcctatccccaaacctctcactacctatgtatttaatctctccctttttctcaacctataaaacactgaagc

SEQ ID NO: 112697 - DNA, 201 bp, Bos taurus; identical to SEQ ID NO: 71432

SEQ ID NO: 112698 - DNA, 201 bp, Bos taurus; identical to SEQ ID NO: 71433

SEQ ID NO: 112699 - DNA, 201 bp, Bos taurus
gtcaacacttgggcggggacgtagactatgctgttttgcagacatcggctccctggctatctgcattagaagcctcagcacaaactccaggagatatcatyagcaatgtgacagtgcccctggtgtgcactagctatggaaatactttttctcactttggcagatacagaagacatctgtgcagcaggctgagccagaaag

SEQ ID NO: 112700 - DNA, 201 bp, Bos taurus; identical to SEQ ID NO: 71434

SEQ ID NO: 112701 - DNA, 201 bp, Bos taurus; identical to SEQ ID NO: 31813

SEQ ID NO: 112702 - DNA, 201 bp, Bos taurus; identical to SEQ ID NO: 31814

SEQ ID NO: 112703 - DNA, 201 bp, Bos taurus; identical to SEQ ID NO: 31815

SEQ ID NO: 112704 - DNA, 201 bp, Bos taurus; identical to SEQ ID NO: 31816

SEQ ID NO: 112705 - DNA, 201 bp, Bos taurus; identical to SEQ ID NO: 31817

SEQ ID NO: 112706 - DNA, 201 bp, Bos taurus; identical to SEQ ID NO: 31819

SEQ ID NO: 112707 - DNA, 201 bp, Bos taurus
tcggtgtcacagctcagtttcattaggaaaacaaagaatagtacaccctcgaagaatgagtctgacccacaagatgaatagaagagaggcctcaatccttytaggtttcctccttttatgcatttgtctcctcaccccggggcctgccctatgtaaattgggctatccaggagggctgtttgttttacctgaggtcctcac

SEQ ID NO: 112708 - DNA, 201 bp, Bos taurus; identical to SEQ ID NO: 31820

SEQ ID NO: 112709 - DNA, 201 bp, Bos taurus
tttcattagttctgttctttttctctctctcattcattaatctctccatttttgctgagacattctccattatctaccacattgtagaactaaatttctcygttatcaaccatcttataaaaaaagaagtaaatcaaaaaccaaaagctaaataaaaattgacactttacttctgtctgtttccgcaaaacccttgaaaga

SEQ ID NO: 112710 - DNA, 201 bp, Bos taurus; identical to SEQ ID NO: 31826

SEQ ID NO: 112711 - DNA, 201 bp, Bos taurus
ccggatctgtgaggtaagaagctgaggttcgggggatatttattaactgatatagacatacagcttatatggagccagaaatatatggaattaacaatttrtaaactgaaatttaatttcagattttattttctttttacagtattttccttaaacataggctgccttgctgtataatgggtagatttgtacatgtatgtg

SEQ ID NO: 112712 - DNA, 201 bp, Bos taurus; identical to SEQ ID NO: 71448

SEQ ID NO: 112713 - DNA, 201 bp, Bos taurus; identical to SEQ ID NO: 71451

SEQ ID NO: 112714 - DNA, 201 bp, Bos taurus
cctatctgttggaatagtcagtaagtaacatgcttctcaaacagaacggcacaggctgaaaggcaaggtgggaagagtgccagatttagagaccaacttgygtttgagacctgactctaccgagcttggtcaaatcaaccaaccatctaagctgcctattttcatcggtgagataggatcatgcccacccatgcacctatc

SEQ ID NO: 112715 - DNA, 201 bp, Bos taurus; identical to SEQ ID NO: 31830

SEQ ID NO: 112716 - DNA, 201 bp, Bos taurus; identical to SEQ ID NO: 71455

SEQ ID NO: 112717 - DNA, 201 bp, Bos taurus; identical to SEQ ID NO: 71456

SEQ ID NO: 112718 - DNA, 201 bp, Bos taurus; identical to SEQ ID NO: 71457

SEQ ID NO: 112719 - DNA, 201 bp, Bos taurus; identical to SEQ ID NO: 31831

SEQ ID NO: 112720 - DNA, 201 bp, Bos taurus; identical to SEQ ID NO: 31860

SEQ ID NO: 112721 - DNA, 201 bp, Bos taurus; identical to SEQ ID NO: 31861

SEQ ID NO: 112722 - DNA, 201 bp, Bos taurus; identical to SEQ ID NO: 31862

SEQ ID NO: 112723 - DNA, 201 bp, Bos taurus; identical to SEQ ID NO: 31863

SEQ ID NO: 112724 - DNA, 201 bp, Bos taurus; identical to SEQ ID NO: 31864

SEQ ID NO: 112725 - DNA, 201 bp, Bos taurus; identical to SEQ ID NO: 31865

SEQ ID NO: 112726 - DNA, 201 bp, Bos taurus; identical to SEQ ID NO: 31866

SEQ ID NO: 112727 - DNA, 201 bp, Bos taurus; identical to SEQ ID NO: 31867

SEQ ID NO: 112728 - DNA, 201 bp, Bos taurus; identical to SEQ ID NO: 31868

SEQ ID NO: 112729 - DNA, 201 bp, Bos taurus; identical to SEQ ID NO: 31869

SEQ ID NO: 112730 - DNA, 201 bp, Bos taurus; identical to SEQ ID NO: 31870

SEQ ID NO: 112731 - DNA, 201 bp, Bos taurus; identical to SEQ ID NO: 31871

SEQ ID NO: 112732 - DNA, 201 bp, Bos taurus; identical to SEQ ID NO: 31872

SEQ ID NO: 112733 - DNA, 201 bp, Bos taurus; identical to SEQ ID NO: 31873

SEQ ID NO: 112734 - DNA, 201 bp, Bos taurus
tcttaaacagtgtcagttatgtgttgaagatgtgaataagatacatccatgctctgttaagagctcagattctccagcctctttgcaagtgggtgtggccrcaagatttcatcctgcccaatgggatgtaaccagaggagaggtatgtaacttgatagtcgtttcttttcccgtttcctgctggctggaatgtgggtgtga

SEQ ID NO: 112735 - DNA, 201 bp, Bos taurus; identical to SEQ ID NO: 71511

SEQ ID NO: 112736 - DNA, 201 bp, Bos taurus; identical to SEQ ID NO: 71512

SEQ ID NO: 112737 - DNA, 201 bp, Bos taurus; identical to SEQ ID NO: 71513

SEQ ID NO: 112738 - DNA, 201 bp, Bos taurus; identical to SEQ ID NO: 71514

SEQ ID NO: 112739 - DNA, 201 bp, Bos taurus; identical to SEQ ID NO: 71515

SEQ ID NO: 112740 - DNA, 201 bp, Bos taurus; identical to SEQ ID NO: 31884

SEQ ID NO: 112741 - DNA, 201 bp, Bos taurus; identical to SEQ ID NO: 71521

SEQ ID NO: 112742 - DNA, 201 bp, Bos taurus; identical to SEQ ID NO: 31888

SEQ ID NO: 112743 - DNA, 201 bp, Bos taurus; identical to SEQ ID NO: 71522

SEQ ID NO: 112744 - DNA, 201 bp, Bos taurus; identical to SEQ ID NO: 71523

SEQ ID NO: 112745 - DNA, 201 bp, Bos taurus; identical to SEQ ID NO: 31889

SEQ ID NO: 112746 - DNA, 201 bp, Bos taurus; identical to SEQ ID NO: 71524

SEQ ID NO: 112747 - DNA, 201 bp, Bos taurus; identical to SEQ ID NO: 71525

SEQ ID NO: 112748 - DNA, 201 bp, Bos taurus; identical to SEQ ID NO: 71526

SEQ ID NO: 112749 - DNA, 201 bp, Bos taurus; identical to SEQ ID NO: 71527

SEQ ID NO: 112750 - DNA, 201 bp, Bos taurus; identical to SEQ ID NO: 71528

SEQ ID NO: 112751 - DNA, 201 bp, Bos taurus; identical to SEQ ID NO: 71529

SEQ ID NO: 112752 - DNA, 201 bp, Bos taurus; identical to SEQ ID NO: 71530

SEQ ID NO: 112753 - DNA, 201 bp, Bos taurus; identical to SEQ ID NO: 71531

SEQ ID NO: 112754 - DNA, 201 bp, Bos taurus; identical to SEQ ID NO: 71532

SEQ ID NO: 112755 - DNA, 201 bp, Bos taurus; identical to SEQ ID NO: 71533

SEQ ID NO: 112756 - DNA, 201 bp, Bos taurus; identical to SEQ ID NO: 71534

SEQ ID NO: 112757 - DNA, 201 bp, Bos taurus; identical to SEQ ID NO: 31890

SEQ ID NO: 112758 - DNA, 201 bp, Bos taurus; identical to SEQ ID NO: 71535

SEQ ID NO: 112759 - DNA, 201 bp, Bos taurus; identical to SEQ ID NO: 31891

SEQ ID NO: 112760 - DNA, 201 bp, Bos taurus; identical to SEQ ID NO: 31892

SEQ ID NO: 112761 - DNA, 201 bp, Bos taurus; identical to SEQ ID NO: 31893

SEQ ID NO: 112762 - DNA, 201 bp, Bos taurus; identical to SEQ ID NO: 71536

SEQ ID NO: 112763 - DNA, 201 bp, Bos taurus; identical to SEQ ID NO: 31894

SEQ ID NO: 112764 - DNA, 201 bp, Bos taurus; identical to SEQ ID NO: 71540

SEQ ID NO: 112765 - DNA, 201 bp, Bos taurus; identical to SEQ ID NO: 71542

SEQ ID NO: 112766 - DNA, 201 bp, Bos taurus; identical to SEQ ID NO: 71543

SEQ ID NO: 112767 - DNA, 201 bp, Bos taurus; identical to SEQ ID NO: 31905

SEQ ID NO: 112768 - DNA, 201 bp, Bos taurus; identical to SEQ ID NO: 31906

SEQ ID NO: 112769 - DNA, 201 bp, Bos taurus; identical to SEQ ID NO: 31909

SEQ ID NO: 112770 - DNA, 201 bp, Bos taurus; identical to SEQ ID NO: 31910

SEQ ID NO: 112771 - DNA, 201 bp, Bos taurus; identical to SEQ ID NO: 31911

SEQ ID NO: 112772 - DNA, 201 bp, Bos taurus; identical to SEQ ID NO: 31912

SEQ ID NO: 112773 - DNA, 201 bp, Bos taurus; identical to SEQ ID NO: 71553

SEQ ID NO: 112774 - DNA, 201 bp, Bos taurus; identical to SEQ ID NO: 31914

SEQ ID NO: 112775 - DNA, 201 bp, Bos taurus; identical to SEQ ID NO: 31915

SEQ ID NO: 112776 - DNA, 201 bp, Bos taurus; identical to SEQ ID NO: 31917

SEQ ID NO: 112777 - DNA, 201 bp, Bos taurus; identical to SEQ ID NO: 71557

SEQ ID NO: 112778 - DNA, 201 bp, Bos taurus; identical to SEQ ID NO: 71558

SEQ ID NO: 112779 - DNA, 201 bp, Bos taurus
cccaactgtccttgtctggccccagccaggactagatcacgtctacctctgtagattctctctccagctccagctgaatcctagatttctgtaacctcagrgtcatcatgcaaaaatataggccagagtgtaagtagcccctaccctaggatcaggattatttaggcatttttgttgcctggttatgatcatttcaaaaca

SEQ ID NO: 112780 - DNA, 201 bp, Bos taurus; identical to SEQ ID NO: 31918

SEQ ID NO: 112781 - DNA, 201 bp, Bos taurus; identical to SEQ ID NO: 31923

SEQ ID NO: 112782 - DNA, 201 bp, Bos taurus
ctcctggtaaaactttccaccccaaagtcaatgctggtgaaatactttctctgagctgaatggtatccacctcttggttgatggccagcgtttgcaaatcmaaaggacctgcaaggtgggagcacttattgtccctgggcacagaaatacactctattaggaccacgttcatgactcaaatgctcagaggccaatgcatta

SEQ ID NO: 112783 - DNA, 201 bp, Bos taurus
gacccactcaagatgaaaaccaaaaccctgcatggcctccatcacatttctggagttatcctgcaaactaccccttcccttcactctctgacttcaggccyctgcctgatacacactttcttccctcttttccagcttacctttcagatctaaattccagcaacaactgcttgccttcccctttaaggtaaatcccctacc

SEQ ID NO: 112784 - DNA, 201 bp, Bos taurus
actaagggatggattgaaagtgctgaacacagtgactgacaggtggcacctaattcctttttccctttagggatgctcttcaacccatttcccttcccacrccttcccaatccagggctttgcagatgggcttcccctgcctggaacccaatgtctccttttcatcttggctgcactctctcaggtactgtgctcctctcc

SEQ ID NO: 112785 - DNA, 201 bp, Bos taurus; identical to SEQ ID NO: 71568

SEQ ID NO: 112786 - DNA, 201 bp, Bos taurus; identical to SEQ ID NO: 71569

SEQ ID NO: 112787 - DNA, 201 bp, Bos taurus; identical to SEQ ID NO: 71570

SEQ ID NO: 112788 - DNA, 201 bp, Bos taurus; identical to SEQ ID NO: 71571

SEQ ID NO: 112789 - DNA, 201 bp, Bos taurus; identical to SEQ ID NO: 71572

SEQ ID NO: 112790 - DNA, 201 bp, Bos taurus; identical to SEQ ID NO: 71573

SEQ ID NO: 112791 - DNA, 201 bp, Bos taurus; identical to SEQ ID NO: 71574

SEQ ID NO: 112792 - DNA, 201 bp, Bos taurus; identical to SEQ ID NO: 71575

SEQ ID NO: 112793 - DNA, 201 bp, Bos taurus
gtttagctttcatcctgtccatttttcagaaacaaagaccctgcaaccttttaagccactaactcctttaaatataataacttggcagtgtccccttcttmagtcagaatctctgttgtcttgcagtcaaccaaaccaggagccttggacaagagactatggctgagagcacgtggcggtgccctccttgcgatgaagact

SEQ ID NO: 112794 - DNA, 201 bp, Bos taurus; identical to SEQ ID NO: 71579

SEQ ID NO: 112795 - DNA, 201 bp, Bos taurus
cctgagggtctcaggaagaccccacaagcctttgatggggggcagcttggcttcccccagggtcttctggacgtcagagccctctaacctacatggcctcsctccttttcaggactctttttttttttttccccttctctctgactccctctcttctctccaactgagggaagtagagcaaagttggggtagtggccctaa

SEQ ID NO: 112796 - DNA, 201 bp, Bos taurus
gttttcaaacattcctagcggaccttgtgtgtatgggcgcttcactagggcccggcatccgcccagcgcctcccgcccttcccagaagccgaggccgaagyacctccactgcaggggaccgaatcacttaaccgcattcgcctttccaggactgatcgctcctcaaaaccgttttccagaagttcacctccttgtccaggc

SEQ ID NO: 112797 - DNA, 201 bp, Bos taurus; identical to SEQ ID NO: 71583

SEQ ID NO: 112798 - DNA, 201 bp, Bos taurus; identical to SEQ ID NO: 71584

SEQ ID NO: 112799 - DNA, 201 bp, Bos taurus
tggtcgctactggctggacaccattctgcttaagtttgtattcacgaccacccatatgaagatgtgggcccccacacggcctctgacacctatgggaacakgtctatgagctggtgagcagtgcttacaattcacaccataagcccggagactggggccaaggagcagagagcatcgtccagcctcagggggacctgttag

SEQ ID NO: 112800 - DNA, 201 bp, Bos taurus
tgggaaaacatcaagtccatgtttagaaagttctagctgcaagctcagtccctctgcaaaatacttagccttcagccagagtaacaagctcagtgtccttkgcatggcctggtgaaaagagcagttgtgtaatccttgctttgggggaccctcctccccaatacactccaagtacatgacatggactttttgatggattcc

SEQ ID NO: 112801 - DNA, 201 bp, Bos taurus; identical to SEQ ID NO: 71591

SEQ ID NO: 112802 - DNA, 201 bp, Bos taurus
ggacagaaaccaatgagccccaactggtctctctgtcctccccacatatatgcactcccttgccttctcttgacctaacaggggtctcctaggccgttttmtgaaataaccagggacactgccactcctggaaccagggcagcccctgaaaaaaagagggagatgataacggcccctctgagcatcccagagaagggtcag

SEQ ID NO: 112803 - DNA, 201 bp, Bos taurus
agtgactaacactttcactttttttcaagattaaaaggtgggtactaacccagtgattaaaaaggccattcattcatctgggcctcagacctagaagacartaaggactggtgggactgtggctctcatgtgagccccagggattcccttctgaagaccatagttgctactcacctctggccagttgttgccatgccggct

SEQ ID NO: 112804 - DNA, 201 bp, Bos taurus
agggccagatggcttctctgatgagttccaccaaacgtttaaagaattaatatcagtccttcataaattcttccaaaaaataggagaaaagggcacacttyccaactcattctgtaaggccagtattgccttgatacaaaaccagacagagacatttaaagaaaagaaacctatggactaatatcccttatgaatatagac

SEQ ID NO: 112805 - DNA, 201 bp, Bos taurus
ccccatagatgaaaggcaaactcttccctgcctccaggtcactgtttggcttgggcttgctgtcctcatcgtcctcccgatgactgccatcggccttgggyggcttcttgagcttgctctcggcgatgcgcctctcgatgtttgccagtgactcaggggtgaaaggcttgaaactatcagggcctggtggtgcgagcagcc

SEQ ID NO: 112806 - DNA, 201 bp, Bos taurus; identical to SEQ ID NO: 71595

SEQ ID NO: 112807 - DNA, 201 bp, Bos taurus; identical to SEQ ID NO: 71596

SEQ ID NO: 112808 - DNA, 201 bp, Bos taurus
gtttttctcctaagcctattccattatctctctttgatcatcagcttactcttcaataaaaatggggattgtaataactaattgttatttgtgcttcatayagtaattcaaagataagctctcttattatttatccctgaaaaaaacagaagtaatctgccccctcgtcacacaggtggtcaggctttactatgtgtttac

SEQ ID NO: 112809 - DNA, 201 bp, Bos taurus
ctatgatatcaacttccagaactctccattccagtttttgggaaaagtccatttcttagaactaacctcagctttgtgtgtaacacaccaattcgttatgrcacttagtctgaaaagcattatctggtcagacctgttatagttatgtgataccaacccgaaaataagaaaagcttaggatacattctaccccaaggactc

SEQ ID NO: 112810 - DNA, 201 bp, Bos taurus; identical to SEQ ID NO: 71597

SEQ ID NO: 112811 - DNA, 201 bp, Bos taurus
tatataatttaaatgcctctcaccctcttttagttactcaggacagttacacaccctcctatgaagacataggtctccttattaaaatttcattttaatgyatgacatatataaaaaggtttatagtatgtatgtaggttttaaaactttctagaatgtgtacttgtgaactcatccccaactcaagagctagaacgtgtg

SEQ ID NO: 112812 - DNA, 201 bp, Bos taurus; identical to SEQ ID NO: 71600

SEQ ID NO: 112813 - DNA, 201 bp, Bos taurus; identical to SEQ ID NO: 71601

SEQ ID NO: 112814 - DNA, 201 bp, Bos taurus
gaacagtacgagaccacagttgaccgtggcctcaactgggactggctccctgtgaatgggatgcagtctgcttacatgctggctgatctgaaacctgtgtrcatggaggccccagggttgttgggggccccaacctgaggatcctcttcatccatcactctccttgactctttccctcccccaggccttaactggaagcaa

SEQ ID NO: 112815 - DNA, 201 bp, Bos taurus
cctgggagatgtggcaggactgagaccgacgtcctctcactgtcttctcttaaatccccagcctgctctcacaggcctgaggctgagtaagggcttgagcrctggaagactgggtgttctgggaaaaggagacttattctgactgctgagccagcagcacccaccccgaccccctgacccaggaggaaattgggccctgcc

SEQ ID NO: 112816 - DNA, 201 bp, Bos taurus; identical to SEQ ID NO: 71602

SEQ ID NO: 112817 - DNA, 201 bp, Bos taurus
ctgtatgcagtcagctgcctcctgcagtcatgggagagaacaggtaaggacagttgccggcgcagtcgctgtgcttggtggccagagctggctttcacacytcatccatgaatccatgaaccacacattgagaactgaccagctaggaaatgtgtaactcagccttcacctttatttagtgaagctcaaggaaggaaagac

SEQ ID NO: 112818 - DNA, 201 bp, Bos taurus
ggcttcagagactggagtgagcggataggggggctggcacaaagtgggcgctgggaggagaaggtcaggctggtggtcgctggagcccactgactggtgcrgggccgtggacttgactctggatttctgagttccagggagcaggcttctgatacccctggatctaccctagtggagggctctgggagtcctatctgcccc

SEQ ID NO: 112819 - DNA, 201 bp, Bos taurus
tagaaccaagactacgcttccccttagcttgcctgttggcgggtgtttgcgttgaaactatactgaaagcctgaccttaaaggggaggaagcagaggggamccggggccctttaaaacgaggccagctggtgcctgcccctttaagggcggggcgctcagacgacagaatctgagccccagattactccgagtttccgtca

SEQ ID NO: 112820 - DNA, 201 bp, Bos taurus
acatctataaatggaatttggcctcttttaatcaggtcatcatcttttaaagttctgtctggagcaccctttgtatgagtccttggcatcctctctgttgytgttgtggtccaggccctcatctttctcctcctggatatcagcttccaaattgtgctgctgcctccagcctcagtctctcctggtacacccttctccaca

SEQ ID NO: 112821 - DNA, 201 bp, Bos taurus
agggccccatggccagcattagaacctgaacctaagtcttctcactccagaacatgcctggagcttgagttgctctggctctcatgtaagatgcatggacygtgttgcatatcctgggccctgggttcatgtttctgtgtcacaaggctctctgatgcccctccagggtgggaaacctcctggcttgttgagggagactga

SEQ ID NO: 112822 - DNA, 201 bp, Bos taurus
ccatcgggacccaggcagtctgggctcttcaccactgagtgaggctacctctggaaaggaaggcagttgcaagagctaagaattgagcctgggcctcccayacgagagctgagaattctaccagtccacctcccaagacactgatacagcacttggagacttgctctgcaggaggtcctagggcagtgggaggaacacagg

SEQ ID NO: 112823 - DNA, 201 bp, Bos taurus
catttagcctgcagtacacacctcctgtggtggcctgtgtctgcattcatctggcttgcaagtggtccaactgggagatcccagtctcaactgatgggaarcactggtgggagtatgttgacgccactgtgaccttggaacttttagatggtaagttttagaggaagggaccttgaaaagcacttgctcttgatctgtcac

SEQ ID NO: 112824 - DNA, 201 bp, Bos taurus
ctacttaaaagattggtcaccagaagaagctctgattagagattactctctccctccctctcagaggccactggggccattcccatcatgacctgactccytgtttgcgtcagttttcacaaaaagtctaagctcctccctccatgactccacatacaggaacttttagtcttttatggccagatacatgccatagcctag

SEQ ID NO: 112825 - DNA, 201 bp, Bos taurus
gttaatccaaagagaatagaagtgtcacttttttaaaaacaacaacaaaatgctgtgaattattagagaactttaggcaattcttggttgggaattgggargttctttcagagagaaggacacctaagaagtggaactgagtcgttggaaagtcagaaaccatataggaaagatgagagtgggggtgggggtgagacagct

SEQ ID NO: 112826 - DNA, 201 bp, Bos taurus; identical to SEQ ID NO: 71603

SEQ ID NO: 112827 - DNA, 201 bp, Bos taurus
gccgggaggtccgcgctgggggaggggcccctgcgaggggcacagacaaaggtcctctgcgatgggtccgatgggggtcccggaggagagggctgaaaccytggggctccatctcacagtccgggccaggggctccagttctacttccacaggggagagtcattcaaattcagctttaactcccatttgctaaatgcctcc

SEQ ID NO: 112828 - DNA, 201 bp, Bos taurus
ccaatgccaccagctttgaattagccttgagcatccacccagctggtctttccatggcaagccttagggatggagaagaaaaatgaatactctgtgctcaygaggccttcagacctgaaacggaacacaccaaacagatccagagagaaaactgaggctcagaccccgtgactggaagaggcctcagagacaagtggacgc

SEQ ID NO: 112829 - DNA, 201 bp, Bos taurus
cagagcccaatccagagaggttgagactaagaagcactaggctgctttgcatgataaaataaaaggatgtcctcaccaggtagggaatggtatgaccttgratttcttaagaatctttggaaatagtgggagtcactaggattgggggtctactatcccaggggatgaaggcttggatctttctatttggatatcacagga

SEQ ID NO: 112830 - DNA, 201 bp, Bos taurus; identical to SEQ ID NO: 71606

SEQ ID NO: 112831 - DNA, 201 bp, Bos taurus; identical to SEQ ID NO: 71607

SEQ ID NO: 112832 - DNA, 201 bp, Bos taurus
aaactccgatcaccagtaaaggccaggagattccatgtaactcaaggtgtctgcatcgtcaagcccatgttttggaccccagtaccatccagaacctcccygtgggctacttaccaggcagagggagcagctacatccttcttgtgctcagatgtccgtgtctaacttagatattagatttaatgaaattccagggcagaa

SEQ ID NO: 112833 - DNA, 201 bp, Bos taurus
acacactgtgcacaaggatcgtgtagctctaccctttcctgggtgagcagaaaacccatctcagagccttttcttatctctcctatcccagagagttggaytgataattagccaaaatattttaagtgaatttccttagtacggtatccaaaagatagtaggatctcaacaaatgttatttttttttttgttttgattgta

SEQ ID NO: 112834 - DNA, 201 bp, Bos taurus
gctatttataggtctacctacacagacttcctctcatcaaaactgatgtaggttctgccgttgtttatcttttgccattgtcagcggcagagaacaatgcrggagaccagcaagccgcatggtggcaaggtgattacatccaacctttccaacatgaaaagtgagtgttggttgctcagtcgtgtctgactcttcacgtag

SEQ ID NO: 112835 - DNA, 201 bp, Bos taurus
ttctcacttttatgttctttcaattgtagttctggggttcccccaaacctccaaaagacttatgtgcctaaggccggagccagatgtgcttgtgactgttyactgaagctgtgtcaccgtgtggaatatcacccctggagttgtcacatgatcacgtgaccaacaaatgggaaaacatgattgattccaccacagaatttg

SEQ ID NO: 112836 - DNA, 201 bp, Bos taurus
gatcgctggatcctgtgtgagcccaagtcttttaaactgcaaaatggacaaaagggtagtatttgcttaaacaaattgctgagaatgagcccaggccaggraacagctcctggactcgtgtacctatgagaggaggggcagagaggtggaccttcacagacagcacatgtgcgcatgggacagaggccagcaagtggcacc

SEQ ID NO: 112837 - DNA, 201 bp, Bos taurus
gcttttcctttttctctagtctatatgttccaagggttacccacccaccagtgggttggcagcagtcccaggacttctcaggccaaacagccacccatgtsggggatcaggctcatctataaggaagataaagcagtcgaccctaccacaacagaagggcccaagcagcccacataaggaataagggacacccctagagca

SEQ ID NO: 112838 - DNA, 201 bp, Bos taurus; identical to SEQ ID NO: 71609

SEQ ID NO: 112839 - DNA, 201 bp, Bos taurus
ggcacagcagttgctcaatgtttgtgagatggatggatggatgaatgaatgaataagtgattaagagatgagaggcctacaaataggttccattttggaaygtttatcctgcaaagatgaggaagcatcagggcaggtggtaggcagaaacagagcagagacgggggagtgggggaagacaggcctggctctggagagtgt

SEQ ID NO: 112840 - DNA, 201 bp, Bos taurus
gaggccgacccctccctccgggccccgtcccaacccgcgcccgccgcctgggctctgcgtgtgggaatgatgtgcgcattggagggtctaagttcttcacrtgcttggggggtcctcccttttttttcttagcaaccaaatcgtactaatcttactaatcagtaaatccaagtcagcggcaggaaagacaagcgatatttt

SEQ ID NO: 112841 - DNA, 201 bp, Bos taurus; identical to SEQ ID NO: 71614

SEQ ID NO: 112842 - DNA, 201 bp, Bos taurus; identical to SEQ ID NO: 71615

SEQ ID NO: 112843 - DNA, 201 bp, Bos taurus; identical to SEQ ID NO: 71616

SEQ ID NO: 112844 - DNA, 201 bp, Bos taurus
ctgccctccatcctgttcttatccagaaacagagcccatatcttagcccaatgcccactgacatggaggagatggccatggtatcttaacaaactacagtmagtgtataagggcaagtcattccacatgactctgggaaaatgtggaggcccctccaaaggacaaaaggatttcttgaagagggctacatgatattcttct

SEQ ID NO: 112845 - DNA, 201 bp, Bos taurus
gcccatgggtaggacagaatcccaaggcctccccaaaccaaacctgccagcaaagtgtgactgatgggagctcttctaaacttctaaacattctgaagggrgatatgctcatggcccaggtcgtgtctgggccagggagggctctaaggcatagtggacaggagtgtgtgtaatgatgtgggtgcaagcttcaaatgacat

SEQ ID NO: 112846 - DNA, 201 bp, Bos taurus; identical to SEQ ID NO: 71620

SEQ ID NO: 112847 - DNA, 201 bp, Bos taurus
gaggctttcatatttttgtatatcttgtgagcagagacactgattggcctttgtttaatacgattggcctttgtttaattttgaaggatgcttttacaccrgaggtggcccatggatcaatttggctcgccatctgttgttgtaaataaagttttattataactcagcacatcaatttacttacatattgtctatttctgc

SEQ ID NO: 112848 - DNA, 201 bp, Bos taurus
gggagagactccccttttggccagcagtagccctggtgatccccaggactctttcgctgccttgtagctgctgtggttgctattcgtgagggactcttccygacccttggcctctagtcccacaagagctaatcaatcactgttgctaacaactcagccttggcttgccaccaagtctgaaattatataagattcactaaa

SEQ ID NO: 112849 - DNA, 201 bp, Bos taurus; identical to SEQ ID NO: 31929

SEQ ID NO: 112850 - DNA, 201 bp, Bos taurus; identical to SEQ ID NO: 31930

SEQ ID NO: 112851 - DNA, 201 bp, Bos taurus; identical to SEQ ID NO: 31931

SEQ ID NO: 112852 - DNA, 201 bp, Bos taurus; identical to SEQ ID NO: 31932

SEQ ID NO: 112853 - DNA, 201 bp, Bos taurus; identical to SEQ ID NO: 31933

SEQ ID NO: 112854 - DNA, 201 bp, Bos taurus; identical to SEQ ID NO: 31936

SEQ ID NO: 112855 - DNA, 201 bp, Bos taurus; identical to SEQ ID NO: 31938

SEQ ID NO: 112856 - DNA, 201 bp, Bos taurus; identical to SEQ ID NO: 31939

SEQ ID NO: 112857 - DNA, 201 bp, Bos taurus; identical to SEQ ID NO: 31940

SEQ ID NO: 112858 - DNA, 201 bp, Bos taurus; identical to SEQ ID NO: 31941

SEQ ID NO: 112859 - DNA, 201 bp, Bos taurus; identical to SEQ ID NO: 31942

SEQ ID NO: 112860 - DNA, 201 bp, Bos taurus; identical to SEQ ID NO: 31944

SEQ ID NO: 112861 - DNA, 201 bp, Bos taurus; identical to SEQ ID NO: 71637

SEQ ID NO: 112862 - DNA, 201 bp, Bos taurus; identical to SEQ ID NO: 71638

SEQ ID NO: 112863 - DNA, 201 bp, Bos taurus; identical to SEQ ID NO: 71639

SEQ ID NO: 112864 - DNA, 201 bp, Bos taurus; identical to SEQ ID NO: 71640

SEQ ID NO: 112865 - DNA, 201 bp, Bos taurus; identical to SEQ ID NO: 71641

SEQ ID NO: 112866 - DNA, 201 bp, Bos taurus; identical to SEQ ID NO: 71642

SEQ ID NO: 112867 - DNA, 201 bp, Bos taurus; identical to SEQ ID NO: 71643

SEQ ID NO: 112868 - DNA, 201 bp, Bos taurus; identical to SEQ ID NO: 71644

SEQ ID NO: 112869 - DNA, 201 bp, Bos taurus; identical to SEQ ID NO: 71645

SEQ ID NO: 112870 - DNA, 201 bp, Bos taurus; identical to SEQ ID NO: 71646

SEQ ID NO: 112871 - DNA, 201 bp, Bos taurus; identical to SEQ ID NO: 71647

SEQ ID NO: 112872 - DNA, 201 bp, Bos taurus; identical to SEQ ID NO: 71648

SEQ ID NO: 112873 - DNA, 201 bp, Bos taurus; identical to SEQ ID NO: 71649

SEQ ID NO: 112874 - DNA, 201 bp, Bos taurus; identical to SEQ ID NO: 71650

SEQ ID NO: 112875 - DNA, 201 bp, Bos taurus; identical to SEQ ID NO: 71651

SEQ ID NO: 112876 - DNA, 201 bp, Bos taurus; identical to SEQ ID NO: 71652

SEQ ID NO: 112877 - DNA, 201 bp, Bos taurus; identical to SEQ ID NO: 71653

SEQ ID NO: 112878 - DNA, 201 bp, Bos taurus; identical to SEQ ID NO: 71654

SEQ ID NO: 112879 - DNA, 201 bp, Bos taurus; identical to SEQ ID NO: 71655

SEQ ID NO: 112880 - DNA, 201 bp, Bos taurus; identical to SEQ ID NO: 71656

SEQ ID NO: 112881 - DNA, 201 bp, Bos taurus; identical to SEQ ID NO: 71657

SEQ ID NO: 112882 - DNA, 201 bp, Bos taurus; identical to SEQ ID NO: 71658

SEQ ID NO: 112883 - DNA, 201 bp, Bos taurus; identical to SEQ ID NO: 71659

SEQ ID NO: 112884 - DNA, 201 bp, Bos taurus; identical to SEQ ID NO: 71660

SEQ ID NO: 112885 - DNA, 201 bp, Bos taurus; identical to SEQ ID NO: 31955

SEQ ID NO: 112886 - DNA, 201 bp, Bos taurus; identical to SEQ ID NO: 71661

SEQ ID NO: 112887 - DNA, 201 bp, Bos taurus; identical to SEQ ID NO: 71662

SEQ ID NO: 112888 - DNA, 201 bp, Bos taurus; identical to SEQ ID NO: 71663

SEQ ID NO: 112889 - DNA, 201 bp, Bos taurus; identical to SEQ ID NO: 31957

SEQ ID NO: 112890 - DNA, 201 bp, Bos taurus; identical to SEQ ID NO: 31958

SEQ ID NO: 112891 - DNA, 201 bp, Bos taurus; identical to SEQ ID NO: 31960

SEQ ID NO: 112892 - DNA, 201 bp, Bos taurus; identical to SEQ ID NO: 31961

SEQ ID NO: 112893 - DNA, 201 bp, Bos taurus; identical to SEQ ID NO: 71666

SEQ ID NO: 112894 - DNA, 201 bp, Bos taurus; identical to SEQ ID NO: 71667

SEQ ID NO: 112895 - DNA, 201 bp, Bos taurus; identical to SEQ ID NO: 71668

SEQ ID NO: 112896 - DNA, 201 bp, Bos taurus; identical to SEQ ID NO: 71670

SEQ ID NO: 112897 - DNA, 201 bp, Bos taurus; identical to SEQ ID NO: 31963

SEQ ID NO: 112898 - DNA, 201 bp, Bos taurus; identical to SEQ ID NO: 71671

SEQ ID NO: 112899 - DNA, 201 bp, Bos taurus; identical to SEQ ID NO: 31964

SEQ ID NO: 112900 - DNA, 201 bp, Bos taurus; identical to SEQ ID NO: 31965

SEQ ID NO: 112901 - DNA, 201 bp, Bos taurus; identical to SEQ ID NO: 31967

SEQ ID NO: 112902 - DNA, 201 bp, Bos taurus; identical to SEQ ID NO: 31968

SEQ ID NO: 112903 - DNA, 201 bp, Bos taurus; identical to SEQ ID NO: 31969

SEQ ID NO: 112904 - DNA, 201 bp, Bos taurus; identical to SEQ ID NO: 31970

SEQ ID NO: 112905 - DNA, 201 bp, Bos taurus; identical to SEQ ID NO: 31971

SEQ ID NO: 112906 - DNA, 201 bp, Bos taurus; identical to SEQ ID NO: 31972

SEQ ID NO: 112907 - DNA, 201 bp, Bos taurus; identical to SEQ ID NO: 31973

SEQ ID NO: 112908 - DNA, 201 bp, Bos taurus; identical to SEQ ID NO: 31974

SEQ ID NO: 112909 - DNA, 201 bp, Bos taurus; identical to SEQ ID NO: 71672

SEQ ID NO: 112910 - DNA, 201 bp, Bos taurus; identical to SEQ ID NO: 31975

SEQ ID NO: 112911 - DNA, 201 bp, Bos taurus; identical to SEQ ID NO: 71675

SEQ ID NO: 112912 - DNA, 201 bp, Bos taurus; identical to SEQ ID NO: 31981

SEQ ID NO: 112913 - DNA, 201 bp, Bos taurus; identical to SEQ ID NO: 71680

SEQ ID NO: 112914 - DNA, 201 bp, Bos taurus; identical to SEQ ID NO: 71683

SEQ ID NO: 112915 - DNA, 201 bp, Bos taurus; identical to SEQ ID NO: 31985

SEQ ID NO: 112916 - DNA, 201 bp, Bos taurus; identical to SEQ ID NO: 71687

SEQ ID NO: 112917 - DNA, 201 bp, Bos taurus; identical to SEQ ID NO: 31992

SEQ ID NO: 112918 - DNA, 201 bp, Bos taurus; identical to SEQ ID NO: 71691

SEQ ID NO: 112919 - DNA, 201 bp, Bos taurus; identical to SEQ ID NO: 71694

SEQ ID NO: 112920 - DNA, 201 bp, Bos taurus; identical to SEQ ID NO: 31995

SEQ ID NO: 112921 - DNA, 201 bp, Bos taurus; identical to SEQ ID NO: 71696

SEQ ID NO: 112922 - DNA, 201 bp, Bos taurus; identical to SEQ ID NO: 71697

SEQ ID NO: 112923 - DNA, 201 bp, Bos taurus; identical to SEQ ID NO: 31998

SEQ ID NO: 112924 - DNA, 201 bp, Bos taurus; identical to SEQ ID NO: 71699

SEQ ID NO: 112925 - DNA, 201 bp, Bos taurus; identical to SEQ ID NO: 71701

SEQ ID NO: 112926 - DNA, 201 bp, Bos taurus; identical to SEQ ID NO: 32000

SEQ ID NO: 112927 - DNA, 201 bp, Bos taurus; identical to SEQ ID NO: 32001

SEQ ID NO: 112928 - DNA, 201 bp, Bos taurus; identical to SEQ ID NO: 71709

SEQ ID NO: 112929 - DNA, 201 bp, Bos taurus; identical to SEQ ID NO: 32008

SEQ ID NO: 112930 - DNA, 201 bp, Bos taurus; identical to SEQ ID NO: 71712

SEQ ID NO: 112931 - DNA, 201 bp, Bos taurus; identical to SEQ ID NO: 71713

SEQ ID NO: 112932 - DNA, 201 bp, Bos taurus; identical to SEQ ID NO: 32010

SEQ ID NO: 112933 - DNA, 201 bp, Bos taurus; identical to SEQ ID NO: 71714

SEQ ID NO: 112934 - DNA, 201 bp, Bos taurus; identical to SEQ ID NO: 32011

SEQ ID NO: 112935 - DNA, 201 bp, Bos taurus; identical to SEQ ID NO: 71715

SEQ ID NO: 112936 - DNA, 201 bp, Bos taurus; identical to SEQ ID NO: 32012

SEQ ID NO: 112937 - DNA, 201 bp, Bos taurus; identical to SEQ ID NO: 71718

SEQ ID NO: 112938 - DNA, 201 bp, Bos taurus; identical to SEQ ID NO: 71719

SEQ ID NO: 112939 - DNA, 201 bp, Bos taurus; identical to SEQ ID NO: 32015

SEQ ID NO: 112940 - DNA, 201 bp, Bos taurus; identical to SEQ ID NO: 32018

SEQ ID NO: 112941 - DNA, 201 bp, Bos taurus; identical to SEQ ID NO: 32019

SEQ ID NO: 112942 - DNA, 201 bp, Bos taurus; identical to SEQ ID NO: 71722

SEQ ID NO: 112943 - DNA, 201 bp, Bos taurus; identical to SEQ ID NO: 71723

SEQ ID NO: 112944 - DNA, 201 bp, Bos taurus; identical to SEQ ID NO: 71724

SEQ ID NO: 112945 - DNA, 201 bp, Bos taurus; identical to SEQ ID NO: 71727

SEQ ID NO: 112946 - DNA, 201 bp, Bos taurus; identical to SEQ ID NO: 32022

SEQ ID NO: 112947 - DNA, 201 bp, Bos taurus; identical to SEQ ID NO: 32025

SEQ ID NO: 112948 - DNA, 201 bp, Bos taurus
caacgcagcagcagcaggctagaagggctgaagtggaggggcatatctgctcttgaggttccagataaagatgtataagaatttcacaatgggttagctcrcctctccctgccaagaatatacagtaggttttcagaacttagctgtgagaggactggagacagctcttgcacaggttctgtcctggctctaaacaaacct

SEQ ID NO: 112949 - DNA, 201 bp, Bos taurus
gttccctgggacaaggatgtcaggaaacccaggtagaagggagaattttctcttataaggactaatgtcagatatggacattcttcatctatatgttctgygtactgccaagagtgaatttgataagaataaattaaaggtatatatgtagattcggggaaaaaagcaatacttcaataagtaaacaaagggaaagttgac

SEQ ID NO: 112950 - DNA, 201 bp, Bos taurus; identical to SEQ ID NO: 32026

SEQ ID NO: 112951 - DNA, 201 bp, Bos taurus
catgagctccatggggatgcccaccagtccctcggcaaaggcgtgcatgggtactgctccagggccgggcactggtcggcctcctggctcaccaccagggygcaagcgatctcggtagcacccctgcaatataccatgcggttgtcccaatgaggttgcagattacacacagagcgtcatgacgggaacgcttggcctcct

SEQ ID NO: 112952 - DNA, 201 bp, Bos taurus
aaaacaatttttaaaaaaatcctaagacatcttaggcctcacagggaactctctcactcctgaaaacctacaactcattaaaaaaacatttggaaaagcaygatgtggactatcttaggccacagaccaagaacacaattccaggttcagtcctgcttggctgcaaaagaaggctaatggtaacagaacttctaaagacaa

SEQ ID NO: 112953 - DNA, 201 bp, Bos taurus; identical to SEQ ID NO: 32027

SEQ ID NO: 112954 - DNA, 201 bp, Bos taurus; identical to SEQ ID NO: 32028

SEQ ID NO: 112955 - DNA, 201 bp, Bos taurus; identical to SEQ ID NO: 71735

SEQ ID NO: 112956 - DNA, 201 bp, Bos taurus
cttcctcactttggatagccaggtttaatttcattaaaatagactttattttttagatcaactttaaatttacaaaaaagtaagaagctagtagagagaaytcccatatattctgcagccaatttcccctaatattagtgtcatgtataagtactgaagatgtgttaaaattaatgaactgatgttgatacactttcacaa

SEQ ID NO: 112957 - DNA, 201 bp, Bos taurus
taggggaggcagtctctctgccttagaaggattgaactgaggattgctagactgagactgcagctaggattaacgggagagagtgcggtggttgattaagrttgtctgcgtcagttgctggaaaggagagtggtggttgtacttttgttacatatttgcaaactctgcctgaggagttgtaatatgttcatcagttcagtt

SEQ ID NO: 112958 - DNA, 201 bp, Bos taurus; identical to SEQ ID NO: 32030

SEQ ID NO: 112959 - DNA, 201 bp, Bos taurus
ttgaccaaaattcggtggaaatgtgttttcttgtgattcgttgggtcctggaagctatatggactgctctctctgacgggagtgatgacacctattcacaratcagttacagagtcactctgctgtacagcagaaattaacaattatttatgaagtaaatcaactatacttcaatttttttaacaaaatataaatcagtta

SEQ ID NO: 112960 - DNA, 201 bp, Bos taurus; identical to SEQ ID NO: 71738

SEQ ID NO: 112961 - DNA, 201 bp, Bos taurus
agtgagaaggtttcgtgggggttttatttggtctatttccaaagggccaagatgtgggaagccttgggttatcatctaagacccagacatatttctggtgrttcatgctccaatgaagcattctggccctaaatttaggcaagggtcaagcctgggtgggtgacccacaactctctctctcatccaagtacaaaggctctc

SEQ ID NO: 112962 - DNA, 201 bp, Bos taurus
cttcagcattccttgctaggactgttgcagtagtctccttgttgtcctgccttttgtgtctccccaatccaatgcacgttctctcagcacaggtctggccrggacacatttttggttacagatagtcacttctttctgttgcagtcagtggtatggagtcagctttccttgacatgaggtctgaggccacaccattactat

SEQ ID NO: 112963 - DNA, 201 bp, Bos taurus
cagagcatttccttctccctgaaaagtaccctggggtctcagcacagacagtcccctcccccagcctgcagaaggctctgccttaaacagtgcaaatgccyctaagatgaccacactggtgggtactgaatgtctgactacgaggacagttctcttctagacgggaagcactgggtgagggccagttgaggatggagtggc

SEQ ID NO: 112964 - DNA, 201 bp, Bos taurus; identical to SEQ ID NO: 71743

SEQ ID NO: 112965 - DNA, 201 bp, Bos taurus
cggcacttagagcagtgcctgcctcatagcaagcagtggaaaaactatgttgaatgtcttcctcagtcatgaagagccatttgtcctctatattttatacyttgttcttgcttctagtttggtagtttttttatgtggaatgatattcataaattcactcatgattataacccagttccctgtgatcctgaactgtgttcg

SEQ ID NO: 112966 - DNA, 201 bp, Bos taurus
accctccaggtttgtttcctcaagagccgccccatcactgcttgtgggcttggaattgagtcaggctctcaatcctgggatctgagggagtgacggggccmctcagcccgcatggggactctgtgcttctcctggctgctgagtaaaacaaggacttctctgctgggggggaagctccaatgtccagtctcagctctcccg

SEQ ID NO: 112967 - DNA, 201 bp, Bos taurus; identical to SEQ ID NO: 71747

SEQ ID NO: 112968 - DNA, 201 bp, Bos taurus
ttgttggttgcaggtggattgcggctctgtggctccactccagatgtcttctgagttctaggatccaggctggggagcagctcctctcagtctcatggccragagtaagagagcagcaaccgaaccataccatggctcttaaaacttctgttcagtgagcgaccctgtcatgtctgcccacattccatctaccaaagcagg

SEQ ID NO: 112969 - DNA, 201 bp, Bos taurus; identical to SEQ ID NO: 71748

SEQ ID NO: 112970 - DNA, 201 bp, Bos taurus
gacaattagaatcccttttaaataacttcttcccctaatcctttttctctctggttcaaaaaattgttgtgtgttttatgagaaggcccaagacttctackatacatggttataaaagaacaacttgtcattgtactgaatttataattctgactatttgaaaaggcccttttcttttcccacaccaaaatgacctctgaa

SEQ ID NO: 112971 - DNA, 201 bp, Bos taurus
aatctttgactgtttttctatttggtagttgctgtttttctcattgatttttaagagcattttattttttagggatattaaccatgtgtctgtaataagasttgcaaatattttctcattttgttcttttatttttgccatacagaaaatgtatttgcatagttgaatttatcagcccttgtttttatggcttctggattt

SEQ ID NO: 112972 - DNA, 201 bp, Bos taurus; identical to SEQ ID NO: 71751

SEQ ID NO: 112973 - DNA, 201 bp, Bos taurus; identical to SEQ ID NO: 71752

SEQ ID NO: 112974 - DNA, 201 bp, Bos taurus; identical to SEQ ID NO: 71753

SEQ ID NO: 112975 - DNA, 201 bp, Bos taurus
gttagagatggagtgcctttgtttctttgtttgcatttttttcctttttgtgtgaaccagtaaaaatcaataaacggccagcaaatgaaagccctgcccayaccagagcttgctgtgtgttgctgtaggaccaagtgggcttccttctaggttggggaacagtggttggttcaggcggagggaacccgagcctgggtctct

SEQ ID NO: 112976 - DNA, 201 bp, Bos taurus
gtaaaagcaactctaatcccaatatttttcaaactgcaggttacagcccattaatgagccattaaatcaacgcagtgcagagattggcaaacgataccccrcaggccaagcttggccaactgcctgtttttataaagttttattggaacacagccaaactcacttgtttacatattatttatagcttctttggcacttgtg

SEQ ID NO: 112977 - DNA, 201 bp, Bos taurus; identical to SEQ ID NO: 71755

SEQ ID NO: 112978 - DNA, 201 bp, Bos taurus; identical to SEQ ID NO: 71760

SEQ ID NO: 112979 - DNA, 201 bp, Bos taurus; identical to SEQ ID NO: 71761

SEQ ID NO: 112980 - DNA, 201 bp, Bos taurus
aaaaatgaatatatgtatatgtataactgaatcactttgctgcacacctgaaacccaatattgtaaatcaaccatgctccagccaaattaaaaaaaaaaamaacactttactgagagaaagatcagtatgaaatgaccagagaagttaaaattcgttttcttccaatgatttaacatttaaatgtccttgcagttttctcc

SEQ ID NO: 112981 - DNA, 201 bp, Bos taurus
tgacgaaaaaatggacccttataaatgttaagaagcttgaccagggatgagatatgacctgcactgtttcctttataagccaaaactcaaactcttaaccmaggtagcatgttgatccccacaggaaggctaatgtgatgtcgacattctgattgatgcatagtttgctcagatggaaagtgaaagaaaatctcaggggag

SEQ ID NO: 112982 - DNA, 201 bp, Bos taurus
attcctggtccaaactgagacaacaaaattaatatttaatcacacagtggacttaggtcacccactctttctgaatttggatcttgggcccagtaggattrtcaactagaagtcctaaatcattttcagatttcccttccagcaggtctattatggaagcagctgtcaatacatataagaccaggataaggaggccatttc

SEQ ID NO: 112983 - DNA, 201 bp, Bos taurus; identical to SEQ ID NO: 71765

SEQ ID NO: 112984 - DNA, 201 bp, Bos taurus
tcatgtcagaagagctctccagcggagaagaacagagcaaatcaaagacctcatagtgtagtaaaagtagcatggactccaaggttggccagagccaaggrtagaacctcaggagcatcacttatttacctgtgaccttgaacacaggatttaacctctgggcctcagtttcctcatccatttgtgggtatgcacttgtac

SEQ ID NO: 112985 - DNA, 201 bp, Bos taurus
gggtaggggtgctgactgtcagatatttattctgctctctgtccccaaccagcaaacgatcgcctgtgccacccctgttttgcttccaggcctctccaccygaaacccacttgctcccatcaaaacctggagtcatctttgattcattccacttctcaccttcacagcccaaacatccccccaagatgcagaggctcggcc

SEQ ID NO: 112986 - DNA, 201 bp, Bos taurus; identical to SEQ ID NO: 32038

SEQ ID NO: 112987 - DNA, 201 bp, Bos taurus
gttaactatggctaaaagagatatgagtgcatgacaggttgacaaaggatggggtctcttttgagctagtaagctagaagtgggcttcccagaattccccrtgtatctccaggatacactgaccatcaaaggcacatgtatgagactgagaagtggaaggggaaaaaatggcagctctttttttcttttcttaccccatga

SEQ ID NO: 112988 - DNA, 201 bp, Bos taurus; identical to SEQ ID NO: 32039

SEQ ID NO: 112989 - DNA, 201 bp, Bos taurus; identical to SEQ ID NO: 71767

SEQ ID NO: 112990 - DNA, 201 bp, Bos taurus; identical to SEQ ID NO: 71768

SEQ ID NO: 112991 - DNA, 201 bp, Bos taurus; identical to SEQ ID NO: 71769

SEQ ID NO: 112992 - DNA, 201 bp, Bos taurus; identical to SEQ ID NO: 71770

SEQ ID NO: 112993 - DNA, 201 bp, Bos taurus; identical to SEQ ID NO: 71771

SEQ ID NO: 112994 - DNA, 201 bp, Bos taurus
ggaggatgtataatcagggaggatttggacagggaacatgaggaaggaacgcagaggagaggagcacccaagcaaaggctgggaggtaggcctgtactttkgtgccatgttcctcccccaaaccactcttctgattcagccaagtgcaccagcagagcagctgacctggccagtccatagggttcccatcggggggcaggt

SEQ ID NO: 112995 - DNA, 201 bp, Bos taurus; identical to SEQ ID NO: 71772

SEQ ID NO: 112996 - DNA, 201 bp, Bos taurus; identical to SEQ ID NO: 32040

SEQ ID NO: 112997 - DNA, 201 bp, Bos taurus
tgaggcatccgcttcgaagatggtgatcttaaataaacacactggtagccccagcactcagtcaaatccagctgccttccccacagaggccccttggtttyagagctcttggttgatttaatcactgaccattcgggtcacttgctcccgtgccttcaatttcccctcttaagtttaaatttaccaataaagagggagccc

SEQ ID NO: 112998 - DNA, 201 bp, Bos taurus
aatttttataaataaataaagccattttatttttctgaaaaattggccctttggtttttataacattgtaacattgtgtcactgctactctataaatatgygactggaaagatgaaaaggccaatcaccagatttaaatgactataagcaaagacattactcaagagaaaacccattcatttggaatcattccaatccccc

SEQ ID NO: 112999 - DNA, 201 bp, Bos taurus
acatgagcatgtgtgtctactatagtagaattccataattaaatggccatctgcttttttctttttaaagcaaaactttgataacttattgcaaataacckagaattataaaccaaaagcaggccttataaaaccagagcatatataataacaatgaatgcacaccatgcagctactgatacagatctaacatgtgatgaa

SEQ ID NO: 113000 - DNA, 201 bp, Bos taurus
aggtctgaatattcttttttgaactgtacagtctctcaccgtagctctgagattctgatttatatctcctcatttctaactgggatcatggctctaaacayacttctggacttttgtgacaagcttctttccaatgattcaaaacagtaacctatatgcaaaaggaggacaacttctgtgccttacaagaattagtaaagt

SEQ ID NO: 113001 - DNA, 201 bp, Bos taurus
gacaggactgaagcaacatagcacacatccttattccaaactattgataaacatgatgtgtcagcctttggtcaagtacaaagttctgggtagtaagtccyatggaggcccaggctctctgggaacctcccaggtttagcaggaggccctcacagggtgagtgctgacctatgctgcccttcgacctgatctgtcctccgc

SEQ ID NO: 113002 - DNA, 201 bp, Bos taurus
cacaagtggctattgtgtaagacagaacaggaggcctccacggtggctcactggtaaagaatctgcctgccaatgcaggagacacgggtttgatccctgaycgaggaaaaccccacaggccactaagcaaccaagcctgtggattgcaactcctgagcctgtgctctagagcctggatgctgcgagtactgagtgtgtgcg

SEQ ID NO: 113003 - DNA, 201 bp, Bos taurus; identical to SEQ ID NO: 32046

SEQ ID NO: 113004 - DNA, 201 bp, Bos taurus; identical to SEQ ID NO: 32047

SEQ ID NO: 113005 - DNA, 201 bp, Bos taurus; identical to SEQ ID NO: 32049

SEQ ID NO: 113006 - DNA, 201 bp, Bos taurus; identical to SEQ ID NO: 32051

SEQ ID NO: 113007 - DNA, 201 bp, Bos taurus; identical to SEQ ID NO: 71782

SEQ ID NO: 113008 - DNA, 201 bp, Bos taurus; identical to SEQ ID NO: 71783

SEQ ID NO: 113009 - DNA, 201 bp, Bos taurus; identical to SEQ ID NO: 71784

SEQ ID NO: 113010 - DNA, 201 bp, Bos taurus; identical to SEQ ID NO: 71785

SEQ ID NO: 113011 - DNA, 201 bp, Bos taurus; identical to SEQ ID NO: 32053

SEQ ID NO: 113012 - DNA, 201 bp, Bos taurus; identical to SEQ ID NO: 32054

SEQ ID NO: 113013 - DNA, 201 bp, Bos taurus; identical to SEQ ID NO: 32055

SEQ ID NO: 113014 - DNA, 201 bp, Bos taurus; identical to SEQ ID NO: 32056

SEQ ID NO: 113015 - DNA, 201 bp, Bos taurus; identical to SEQ ID NO: 32057

SEQ ID NO: 113016 - DNA, 201 bp, Bos taurus
accctgaggcagtgttgctggcaggcccaagagatgggatatcaaacctatcattttacagatgaggaaactgaggcctgtaagggcacatgacaagctgmggtcacagagatccgaccgctaaggagagccttcagttcaagcctgggccgacccccacagtcacgcccaccccgcactcctctggccctaaccctgcct

SEQ ID NO: 113017 - DNA, 201 bp, Bos taurus; identical to SEQ ID NO: 32059

SEQ ID NO: 113018 - DNA, 201 bp, Bos taurus; identical to SEQ ID NO: 32060

SEQ ID NO: 113019 - DNA, 201 bp, Bos taurus; identical to SEQ ID NO: 32061

SEQ ID NO: 113020 - DNA, 201 bp, Bos taurus; identical to SEQ ID NO: 32062

SEQ ID NO: 113021 - DNA, 201 bp, Bos taurus; identical to SEQ ID NO: 32063

SEQ ID NO: 113022 - DNA, 201 bp, Bos taurus; identical to SEQ ID NO: 71793

SEQ ID NO: 113023 - DNA, 201 bp, Bos taurus; identical to SEQ ID NO: 32064

SEQ ID NO: 113024 - DNA, 201 bp, Bos taurus; identical to SEQ ID NO: 32066

SEQ ID NO: 113025 - DNA, 201 bp, Bos taurus; identical to SEQ ID NO: 71795

SEQ ID NO: 113026 - DNA, 201 bp, Bos taurus; identical to SEQ ID NO: 32067

SEQ ID NO: 113027 - DNA, 201 bp, Bos taurus; identical to SEQ ID NO: 32068

SEQ ID NO: 113028 - DNA, 201 bp, Bos taurus; identical to SEQ ID NO: 32069

SEQ ID NO: 113029 - DNA, 201 bp, Bos taurus; identical to SEQ ID NO: 32070

SEQ ID NO: 113030 - DNA, 201 bp, Bos taurus; identical to SEQ ID NO: 32071

SEQ ID NO: 113031 - DNA, 201 bp, Bos taurus; identical to SEQ ID NO: 32074

SEQ ID NO: 113032 - DNA, 201 bp, Bos taurus; identical to SEQ ID NO: 32075

SEQ ID NO: 113033 - DNA, 201 bp, Bos taurus; identical to SEQ ID NO: 32076

SEQ ID NO: 113034 - DNA, 201 bp, Bos taurus; identical to SEQ ID NO: 32077

SEQ ID NO: 113035 - DNA, 201 bp, Bos taurus; identical to SEQ ID NO: 32079

SEQ ID NO: 113036 - DNA, 201 bp, Bos taurus; identical to SEQ ID NO: 32083

SEQ ID NO: 113037 - DNA, 201 bp, Bos taurus
tcccagccacgtgagtttgagtcacaagcaatgttttggctgggttcaaatcccagaacatgggttcaagtcccaatctgaggtaaatggtttcacaatgrcataacagatctgtaaagcaatctcaacagcctacttaacattggtccattatcaagagatggacttgctttttaaaaaagtaaacgaacaaaaagaaac

SEQ ID NO: 113038 - DNA, 201 bp, Bos taurus; identical to SEQ ID NO: 32087

SEQ ID NO: 113039 - DNA, 201 bp, Bos taurus
gtggcaggcctgtaatgtggtccaggtactagacatctggagggaatatgatcagaaggaataggctgcttgctcgctcgctctctttttttgcatctatrgtcgccatggccaaactcaggagtaggtcagagtaaaacatgtctgtggggagaaatggcccagacagtaggcacttcatcagtgcaggcttgcttgggt

SEQ ID NO: 113040 - DNA, 201 bp, Bos taurus
tacacaggctgtagccatcaagagcatgaaaggaaatactgggcttcttttctttcttttaggcttcatgttaggaagaggcatttgctttcctgaacagractttcagaaattttttattcaggccattggttgtatttcaaatgattgtctttcctaaattatttcccaatatctatgatttccatctaattttgcttt

SEQ ID NO: 113041 - DNA, 201 bp, Bos taurus; identical to SEQ ID NO: 32091

SEQ ID NO: 113042 - DNA, 201 bp, Bos taurus; identical to SEQ ID NO: 71816

SEQ ID NO: 113043 - DNA, 201 bp, Bos taurus; identical to SEQ ID NO: 32092

SEQ ID NO: 113044 - DNA, 201 bp, Bos taurus
gtatgtgtagttggccagtggcttcttgattagtttaaaaagtcagtttaaagtgaagaatcacaaaataaataatgcacactaaaatgttttattgtacyctaaagtttcacagatacccccatttaccaattctcttaatgtcataccaagtctttttctttgagtaagagtctgctgattagaattggcaaaaaacac

SEQ ID NO: 113045 - DNA, 201 bp, Bos taurus; identical to SEQ ID NO: 71818

SEQ ID NO: 113046 - DNA, 201 bp, Bos taurus
ttcatgttatttactaaatagaaagagagtatatatatctaaatgggcatctgccaaacaatattagacagtgactactttgcacaagacaaagtgagtgyatccacacacacacacacacacacaaatccaggaatcagaactcaagacagcatctaaaaatagggtccacgtgaccagattctacaaatagtaggcaga

SEQ ID NO: 113047 - DNA, 201 bp, Bos taurus; identical to SEQ ID NO: 32097

SEQ ID NO: 113048 - DNA, 201 bp, Bos taurus; identical to SEQ ID NO: 32098

SEQ ID NO: 113049 - DNA, 201 bp, Bos taurus
tgagtcccccaactccttgttccacacttcagggcaggaaccacggtggaggttgggcgggcggcggagggggggggcttgagatagacacagatgggccmgaagaaagggcatgcctgtcctttcttgagttacattgattcttctccccacttctgaatggctctgggccatcctgggctctgccatcgtttttttttt

SEQ ID NO: 113050 - DNA, 201 bp, Bos taurus; identical to SEQ ID NO: 32100

SEQ ID NO: 113051 - DNA, 201 bp, Bos taurus; identical to SEQ ID NO: 32101

SEQ ID NO: 113052 - DNA, 201 bp, Bos taurus; identical to SEQ ID NO: 32104

SEQ ID NO: 113053 - DNA, 201 bp, Bos taurus; identical to SEQ ID NO: 32105

SEQ ID NO: 113054 - DNA, 201 bp, Bos taurus; identical to SEQ ID NO: 32106

SEQ ID NO: 113055 - DNA, 201 bp, Bos taurus
gggaaaaaaagcttccgcttcctctctcctcccggcaaaaaaaaaaaaaaaaaaaaggaaagatccatacgcaccactgacaagaaaataaaaccggcccyagagaacaaggcaagccggtgaaccctgacagtccacgcagtgagagcctccacttggcaggcgaagaggccgctggctcccgcccggccccgcagccgc

SEQ ID NO: 113056 - DNA, 201 bp, Bos taurus
ctcccgcccacccacctccccacaattatcctttaaccaggatttacctgatgtttctgaatcctgagttgtcacaaaataaggtagagtattgttcttcyagcttgtattggtaacaaaggggcctggtttatattttctaacttaatttttcatctacatatctatttaggaaacacttatattaaggaaaactgttaa

SEQ ID NO: 113057 - DNA, 201 bp, Bos taurus; identical to SEQ ID NO: 32107

SEQ ID NO: 113058 - DNA, 201 bp, Bos taurus; identical to SEQ ID NO: 32110

SEQ ID NO: 113059 - DNA, 201 bp, Bos taurus; identical to SEQ ID NO: 32111

SEQ ID NO: 113060 - DNA, 201 bp, Bos taurus; identical to SEQ ID NO: 32112

SEQ ID NO: 113061 - DNA, 201 bp, Bos taurus
cccctgacgattgtgactgtgtggcttactccagtaaagggacactccatttccttattctgctcctcccctccactgtcagtcagctttcccaacatcayagtcagtcctctgggccactactctagactgaatacttaactctttacaactccatggactgtagcctgccaggctcctctgtccttgggattttctagg

SEQ ID NO: 113062 - DNA, 201 bp, Bos taurus; identical to SEQ ID NO: 71834

SEQ ID NO: 113063 - DNA, 201 bp, Bos taurus
ttgagatttttgctgacccaagtggggaaggaagaactttgttctctgatattgtaaacaggtaggcctagaatcttacaacaatggccatgtccccatakgtgaaaaaggcaagcctgtaattaaggaggaagacagctgagatccagaaagaaaaaacaggagagattcttgatggcatttagaatcttgactccaggt

SEQ ID NO: 113064 - DNA, 201 bp, Bos taurus; identical to SEQ ID NO: 71836

SEQ ID NO: 113065 - DNA, 201 bp, Bos taurus; identical to SEQ ID NO: 32117

SEQ ID NO: 113066 - DNA, 201 bp, Bos taurus
tcaggaacaatctttgggcttaaaaaggaaacagacattgcagcaactctagtaactttgatttatactgtgtggctttaggaaaagacaaagaataatgygttgaaaattagcaaaatattgagtttttttccccaaaaagctttgcaataagagttacaagcagagttctttccatgagcacccgctcaccattcctct

SEQ ID NO: 113067 - DNA, 201 bp, Bos taurus; identical to SEQ ID NO: 32118

SEQ ID NO: 113068 - DNA, 201 bp, Bos taurus; identical to SEQ ID NO: 32119

SEQ ID NO: 113069 - DNA, 201 bp, Bos taurus
tttatacacacaggcagagaattttttcacacagttggtgagaccacattgatccagcaatttgaatattattattatccgtggtctctctcattaaatasttaagaaaacatagtaaaattgttaaggatacacatttagaatgctatatagctctagctctattcaagttggcaagtgattaacactgcttaaaaattc

SEQ ID NO: 113070 - DNA, 201 bp, Bos taurus
tttcctcatgtctagcaattcctcataattaactagaaggttggggccacactgacaccattacccctctgaatatctggctctaatttatgagccatatyctgcctaatatgccagaatgcttttgaatgttctctcattgcttattttttcttggagtcatagatttgtaaatcagttacatgcaacaatgaaaagatg

SEQ ID NO: 113071 - DNA, 201 bp, Bos taurus; identical to SEQ ID NO: 32121

SEQ ID NO: 113072 - DNA, 201 bp, Bos taurus; identical to SEQ ID NO: 32122

SEQ ID NO: 113073 - DNA, 201 bp, Bos taurus; identical to SEQ ID NO: 32124

SEQ ID NO: 113074 - DNA, 201 bp, Bos taurus; identical to SEQ ID NO: 32125

SEQ ID NO: 113075 - DNA, 201 bp, Bos taurus; identical to SEQ ID NO: 32126

SEQ ID NO: 113076 - DNA, 201 bp, Bos taurus
ggctctagttccctgaccgaggattgaactcgaggccccagcattgagggtgtggagtcttagccactgaatcacaaggcaggtccttgataaaccattcrgacatttttctggccttgagcctaaccactgtcttatggaaaagacctgatactctctctgtccctgtctctgtccatcgccaaccaccctctttccctc

SEQ ID NO: 113077 - DNA, 201 bp, Bos taurus
gtgccattgccttctcccacccttgatatataaccaggtatgaaccactgtcagtctctttaaatctactgaaaagttattttaacttgtgaatggccaarttaggtcccagcagtattaaaagttctggtttatttatttgtgcaagcccaatgtatatcagatcctgtaagacttgaggcctctttatatttctgtaat

SEQ ID NO: 113078 - DNA, 201 bp, Bos taurus
ttgcttttggacctgtgaagtatgagctcctcattggccatctaagtagatatgcaaaatagttattcaagcccagatatgcaaatttgtgattcaccagmataaagatgctatttaaggccaagacatgggatgaggttgtttagggagtagcacagatggaatggagaggagggataaggccaatgccctggggaaggt

SEQ ID NO: 113079 - DNA, 201 bp, Bos taurus; identical to SEQ ID NO: 32130

SEQ ID NO: 113080 - DNA, 201 bp, Bos taurus; identical to SEQ ID NO: 71844

SEQ ID NO: 113081 - DNA, 201 bp, Bos taurus; identical to SEQ ID NO: 71845

SEQ ID NO: 113082 - DNA, 201 bp, Bos taurus; identical to SEQ ID NO: 32132

SEQ ID NO: 113083 - DNA, 201 bp, Bos taurus; identical to SEQ ID NO: 71846

SEQ ID NO: 113084 - DNA, 201 bp, Bos taurus; identical to SEQ ID NO: 71848

SEQ ID NO: 113085 - DNA, 201 bp, Bos taurus; identical to SEQ ID NO: 71849

SEQ ID NO: 113086 - DNA, 201 bp, Bos taurus
caagcatccagtgttcaagcttgtctgggggctacctgagggactggtttctgtctctcctgactccaaatgctaactgaactggtggcataatttgcaaratgctgaaaataggccagaaactagtcacattagaactacatttccacatgcaaataccaagaagaataagagatcagaaaatgtttgaaaggtcctgga

SEQ ID NO: 113087 - DNA, 201 bp, Bos taurus; identical to SEQ ID NO: 32137

SEQ ID NO: 113088 - DNA, 201 bp, Bos taurus
aactccccactcattggccaatgtttttaccatcctttacttaagctttgaagctcaagaatctctttcccaaaaccatataaatacaaaacaagtggaayggtctaggagaggacatggaagggccagctgttttggcctagtcaaatagaggtgaccttttaacaggtcttggtaaaggtaaggccatggaaaagtatc

SEQ ID NO: 113089 - DNA, 201 bp, Bos taurus; identical to SEQ ID NO: 32139

SEQ ID NO: 113090 - DNA, 201 bp, Bos taurus; identical to SEQ ID NO: 32140

SEQ ID NO: 113091 - DNA, 201 bp, Bos taurus
agctttttctaagacctcgaccacttcattcttctttaattgtatagaattgacacttggaggcatctaactgggatgtcagtaaccttacacaactcagmactaaatagttttcttccttataaagtctagaaatcaagaaaagctgaggatatagctaaattatttaggcaatagcacctatgaaaactcaggtaaaaa

SEQ ID NO: 113092 - DNA, 201 bp, Bos taurus; identical to SEQ ID NO: 32147

SEQ ID NO: 113093 - DNA, 201 bp, Bos taurus; identical to SEQ ID NO: 71864

SEQ ID NO: 113094 - DNA, 201 bp, Bos taurus; identical to SEQ ID NO: 32148

SEQ ID NO: 113095 - DNA, 201 bp, Bos taurus; identical to SEQ ID NO: 32149

SEQ ID NO: 113096 - DNA, 201 bp, Bos taurus
tcttggagggactactccaacaggaaagtgggaacctaaaagtaaaaagagtagtaagttctataaaacatcttcacatgacaccatctctctcactgatytattcagtttctgagacttttaaaattagaatgcaaatttattgtttgaaaagagatagggaaacataataacccttcattagtcattttatctataagc

SEQ ID NO: 113097 - DNA, 201 bp, Bos taurus; identical to SEQ ID NO: 32150

SEQ ID NO: 113098 - DNA, 201 bp, Bos taurus; identical to SEQ ID NO: 32151

SEQ ID NO: 113099 - DNA, 201 bp, Bos taurus; identical to SEQ ID NO: 32152

SEQ ID NO: 113100 - DNA, 201 bp, Bos taurus; identical to SEQ ID NO: 71869

SEQ ID NO: 113101 - DNA, 201 bp, Bos taurus
ctgtactacccaatgacccctcattattaagattgttccttctaaagcccagagttcagagaacaaactccaggctgttctctgtgaaggggtggcccatrgtgagaacaagaatggacaaccgaatccatgatggctttgcatgaaggaccctgtccagtagcaataaaggccactagttaagtcaattagacaaaactc

SEQ ID NO: 113102 - DNA, 201 bp, Bos taurus
aacaactcatattggactgacctgtgccaaacaaacacttcaacaaactcagaaatcgaaccaaggtctgcaggtggattctttaccaactgacctatcakggaagccctatataattatttatggggatctatattacaaattttaaggcttgtctgagatgtagttatatattaaaaaaaaaaaaagactagctgaggg

SEQ ID NO: 113103 - DNA, 201 bp, Bos taurus; identical to SEQ ID NO: 32155

SEQ ID NO: 113104 - DNA, 201 bp, Bos taurus
ggtcgcaaagaatcggacatgactgagcaactgaattgaactgaactgaaacatgaagcccgattccaccaagatggtggaaacaatctcagttaggaccrtggcctgggttcatgaatacccccttttccagggtttttttctatgttccaggaggatttatgtggtagcaaaatactgttgggagtggaggtaagaagg

SEQ ID NO: 113105 - DNA, 201 bp, Bos taurus
ggtattaatttataagtgattttttatttgaaacttttcattcattttaatgagtcctaatgcacagattctgactataacctttgcaattgaatcagtgwttctcaacctatgttctcaagaacactggagtttggtgagaggtataatgaagttctgtaacacaaaagtttaacaataaaacatttttgggaaatggca

SEQ ID NO: 113106 - DNA, 201 bp, Bos taurus; identical to SEQ ID NO: 32158

SEQ ID NO: 113107 - DNA, 201 bp, Bos taurus; identical to SEQ ID NO: 71874

SEQ ID NO: 113108 - DNA, 201 bp, Bos taurus; identical to SEQ ID NO: 32160

SEQ ID NO: 113109 - DNA, 201 bp, Bos taurus; identical to SEQ ID NO: 32162

SEQ ID NO: 113110 - DNA, 201 bp, Bos taurus
tagtctttctgagttacagaagaaccacagttatactctgaactttcccatctccatgaattttcctcctagacttggttttactttctcagtcagtcccrtcttgcttcaaaaccatccatcacaacccagctcaattgttacttcctttgcatatctttctccaaatcccttaactggaagtgctctatttcctgacat

SEQ ID NO: 113111 - DNA, 201 bp, Bos taurus
aatagtagaatcagagttggaagtaacccgcgtgtcttttcatccaaccccctcatttttctttttagcaattctggggtgtgatgtaaacagacggtagygagtccacatgctccagactcactcattaaaaacacaaaacggcttctgccactcttgtgttcctttccagctacgatgggtcccgcttcctttcttgca

SEQ ID NO: 113112 - DNA, 201 bp, Bos taurus
tcagatgaccagagaagggactcagccatacatattcatgtatttattctcccccaaacttctcttccatccaggctgccacataacattgagcagagttycatgtgagaagcacgcacattttccttcagtttgctacggctccatttctgtgcagatttcttacatttttgggcatactgacctcatcagtaacattct

SEQ ID NO: 113113 - DNA, 201 bp, Bos taurus; identical to SEQ ID NO: 71880

SEQ ID NO: 113114 - DNA, 201 bp, Bos taurus; identical to SEQ ID NO: 71881

SEQ ID NO: 113115 - DNA, 201 bp, Bos taurus; identical to SEQ ID NO: 32165

SEQ ID NO: 113116 - DNA, 201 bp, Bos taurus; identical to SEQ ID NO: 32168

SEQ ID NO: 113117 - DNA, 201 bp, Bos taurus; identical to SEQ ID NO: 32170

SEQ ID NO: 113118 - DNA, 201 bp, Bos taurus; identical to SEQ ID NO: 32171

SEQ ID NO: 113119 - DNA, 201 bp, Bos taurus; identical to SEQ ID NO: 32172

SEQ ID NO: 113120 - DNA, 201 bp, Bos taurus
acctgtccccaggctatgatgctcactggggccccagtagactctggaatgttctggaacaatggaagcctctgattctggccacccaccagtggcccttygccctcacatgcaagcctggagcacccatgctgctgggtacccatctcctggctcccagtcatcttcctttggccaccaagtgtgagggcagagaccatc

SEQ ID NO: 113121 - DNA, 201 bp, Bos taurus; identical to SEQ ID NO: 32173

SEQ ID NO: 113122 - DNA, 201 bp, Bos taurus; identical to SEQ ID NO: 32174

SEQ ID NO: 113123 - DNA, 201 bp, Bos taurus; identical to SEQ ID NO: 32175

SEQ ID NO: 113124 - DNA, 201 bp, Bos taurus; identical to SEQ ID NO: 32176

SEQ ID NO: 113125 - DNA, 201 bp, Bos taurus
gattttatgatgatgaggttagctttctgggttttctccggccactcatcttgactgtgcccacatttggttcaattcaaggcccttcctgctggcacacrcatctctcagtcaagatgtttcccagcacgagcgttttagggaggttggcagaacatcttatgggttggcctctcctccctccttttggcccctcccaag

SEQ ID NO: 113126 - DNA, 201 bp, Bos taurus; identical to SEQ ID NO: 71893

SEQ ID NO: 113127 - DNA, 201 bp, Bos taurus
cacagacgtccccaaactcagaacccaggcctgcctgcccagggttctggaaagatggaacaacacatggaaaggagctgtttagctggggatccttctgytcagctcctgagcccaggccagccttcatagctttgagcgggtggcttaaccctttcctcctcggcttcccagtctgtaggttggggctaacacctcctc

SEQ ID NO: 113128 - DNA, 201 bp, Bos taurus
gcagctgaaaaaagcacaggtctgtgtgaagggtgtgaagggacaggagagcatgtgctcctcatgtcaggaacgagtaaccacagtggaaggccagtccragtctcgacatcagctctgtgacaatgtcccacagcaacaatgcttgaacacacagacgggggcccagtactgtaggagcagggccgtctggacacgtgc

SEQ ID NO: 113129 - DNA, 201 bp, Bos taurus; identical to SEQ ID NO: 71894

SEQ ID NO: 113130 - DNA, 201 bp, Bos taurus; identical to SEQ ID NO: 32179

SEQ ID NO: 113131 - DNA, 201 bp, Bos taurus; identical to SEQ ID NO: 71895

SEQ ID NO: 113132 - DNA, 201 bp, Bos taurus; identical to SEQ ID NO: 32181

SEQ ID NO: 113133 - DNA, 201 bp, Bos taurus
gaatgatttaaccaaatggcctgtcttgttgggtacacatgggctgttgtgttgaacaactctgggagacaccatagatgttatattcatattatgctgtyacctgaatgatgaaaaatatttgccaaagatgataatttggagtttagagaagatgaccctaagcaatttctttttttttttttctgatagtaatcagat

SEQ ID NO: 113134 - DNA, 201 bp, Bos taurus; identical to SEQ ID NO: 71904

SEQ ID NO: 113135 - DNA, 201 bp, Bos taurus
ctactgggtggatacaggagcaagcatgcctggtaagagctgcagctttgcaattaacctgaggggcagctatggattctactggagttcctcaggcaggsggccagaatgagtgtcacccatgggtgacaaccttaagactgaatgtagagtgtctatgttcatcatgtatattttatgtatgatagtttatgtctgctt

SEQ ID NO: 113136 - DNA, 201 bp, Bos taurus
aggactccatgttctcactgctgatggcccaagttcaatacctgtttggggaagtaagacccacaagccatgaggtgaggccaaaaaaccccccttttttkggggaggaatcaaatcttttacatgtataataaaaataaggcagtgacagcgcacaagtgcacaaggcggcttcgatggcgcataagcgtggccgagagg

SEQ ID NO: 113137 - DNA, 201 bp, Bos taurus; identical to SEQ ID NO: 32189

SEQ ID NO: 113138 - DNA, 201 bp, Bos taurus; identical to SEQ ID NO: 32190

SEQ ID NO: 113139 - DNA, 201 bp, Bos taurus
ctgcaacattctcaacccctttccccacctgtcttgtgcaaatgtcaaaaatagaatctctgcccaaagcaaaggagagcaggaagttattgtcggttcayggtctctggccccagcttgcccactccggttcttccatggaaatcagattttgcagcagtgtttgttgtgagactaaagtatccctattttttttttcta

SEQ ID NO: 113140 - DNA, 201 bp, Bos taurus
ttctcttatcccctagatttctattccctccacatttaactctgtaaaccttaatataatgtgccctacttgtatcctttgttgtttatgtgaagtgtgtrgtgttagtcactcagttgtgtccaactttaaggatggtagcccaccaggctcttctgtccatggaattctccaggcaagaatactggagtgggttgtcag

SEQ ID NO: 113141 - DNA, 201 bp, Bos taurus; identical to SEQ ID NO: 32191

SEQ ID NO: 113142 - DNA, 201 bp, Bos taurus; identical to SEQ ID NO: 32193

SEQ ID NO: 113143 - DNA, 201 bp, Bos taurus; identical to SEQ ID NO: 32195

SEQ ID NO: 113144 - DNA, 201 bp, Bos taurus; identical to SEQ ID NO: 32196

SEQ ID NO: 113145 - DNA, 201 bp, Bos taurus; identical to SEQ ID NO: 32198

SEQ ID NO: 113146 - DNA, 201 bp, Bos taurus; identical to SEQ ID NO: 32199

SEQ ID NO: 113147 - DNA, 201 bp, Bos taurus; identical to SEQ ID NO: 32200

SEQ ID NO: 113148 - DNA, 201 bp, Bos taurus; identical to SEQ ID NO: 32201

SEQ ID NO: 113149 - DNA, 201 bp, Bos taurus
agcagcctggatccagggtggatgcctcctaagactggtgaggacaggcttcgatacatgaagcactggtggagagggagaaagagcccacagggagcttwgggaccaggtgggccagtgggggcgaggaacactgaccatggacggggtggggggggaacacggggtggggccaggtaccaccagagagagtgcagtaat

SEQ ID NO: 113150 - DNA, 201 bp, Bos taurus; identical to SEQ ID NO: 71907

SEQ ID NO: 113151 - DNA, 201 bp, Bos taurus; identical to SEQ ID NO: 71909

SEQ ID NO: 113152 - DNA, 201 bp, Bos taurus
atgaatgagcaactaacacacacacacacacacacacacacacacacacacacacacacacatttggttgtaacaggtcttagttgtggccctcaagatckttgattttcatagcattcaggatctagttgcagcatgtgagatctagttccctgcacagggatccaacctgggccccctgcattgggagggcagaacctt

SEQ ID NO: 113153 - DNA, 201 bp, Bos taurus; identical to SEQ ID NO: 71910

SEQ ID NO: 113154 - DNA, 201 bp, Bos taurus; identical to SEQ ID NO: 71911

SEQ ID NO: 113155 - DNA, 201 bp, Bos taurus
tggccctggagaggtccaagtccactcccacattcaccacagcctctgtgtcacattcattccttcctgacttcttttttttatctttatgcgggagttgyttttgagctctgtggaagttctggcctttcaaggttgcactttacactgtaagaaatttttataatatggaatctatatctttagtaaatacagggctat

SEQ ID NO: 113156 - DNA, 201 bp, Bos taurus
agggcaacccgagacagtggccccaacggagctgcggggactcggggttgggtctgcactgactcactgcacactgcaggcctcggctgaggtggcatcaygaagacgccctgccgagatgctccgagcctcggagagattcaagatgtggagcgagttgctgggtatggtggaaggtactgagtgaccagggcccagatg

SEQ ID NO: 113157 - DNA, 201 bp, Bos taurus
gaaccctggttgttcctgaaacagagctgctggctgactaaggacaagaagaacagggttaacggagaagagaaggccaggaaacaacccccctcagctgmgatttccagtgtctttagggtaggaaccctgaacacacagccacagttcccaggaaggccctgaggaaggggggattcccatgagatttagaaagggaca

SEQ ID NO: 113158 - DNA, 201 bp, Bos taurus; identical to SEQ ID NO: 32206

SEQ ID NO: 113159 - DNA, 201 bp, Bos taurus; identical to SEQ ID NO: 32207

SEQ ID NO: 113160 - DNA, 201 bp, Bos taurus; identical to SEQ ID NO: 32208

SEQ ID NO: 113161 - DNA, 201 bp, Bos taurus; identical to SEQ ID NO: 32209

SEQ ID NO: 113162 - DNA, 201 bp, Bos taurus; identical to SEQ ID NO: 32210

SEQ ID NO: 113163 - DNA, 201 bp, Bos taurus; identical to SEQ ID NO: 32211

SEQ ID NO: 113164 - DNA, 201 bp, Bos taurus
acatgagggaccagcgggagtggatggggacgggtcttcttaacgcatatgatgtccagggctcagtgggttattgatcagagtcgagtgtggcctgcagygggaaggtgtgttcagggtgagtcagaaaggggtcaagacagaggctgcagtcggggcactctgctcctcctctgaaaagagaagaaagggaaccgggcc

SEQ ID NO: 113165 - DNA, 201 bp, Bos taurus; identical to SEQ ID NO: 32212

SEQ ID NO: 113166 - DNA, 201 bp, Bos taurus
gatctgacttggacgtcgaatcttgacagagatgatcaagttaaaacaagggtgagtcccaatcctgtatgagtggtgtccttacgaaaaggggaaatgtrggccaagacagacaggcgtagagggaagacgatgtgaaagcacttggggagggcgctatgtgaaggttatagagatttgttacaaggttataacaggtta

SEQ ID NO: 113167 - DNA, 201 bp, Bos taurus
ttgtgctcagatgggaggatttcctctgatggaattcacagcttgactgccgagcagggaggtgccataggtgagtcccaggtgagaggatcccgggacayggtctcccacacctctcttggaacaaccctcagctttggcctgcctacccctgtgggaccccagagcccctgacctggtactccgggaatctctatctgc

SEQ ID NO: 113168 - DNA, 201 bp, Bos taurus; identical to SEQ ID NO: 32213

SEQ ID NO: 113169 - DNA, 201 bp, Bos taurus; identical to SEQ ID NO: 32214

SEQ ID NO: 113170 - DNA, 201 bp, Bos taurus; identical to SEQ ID NO: 32215

SEQ ID NO: 113171 - DNA, 201 bp, Bos taurus; identical to SEQ ID NO: 32224

SEQ ID NO: 113172 - DNA, 201 bp, Bos taurus; identical to SEQ ID NO: 32225

SEQ ID NO: 113173 - DNA, 201 bp, Bos taurus
gggaggaaccatcaagagagacactgctctgcacacgaacctcgtgatcttgctctgctgctgtggcctctggtggccttgggttttcaagcgttcgggarcttgggttccgtgggcattctgaggaaagtcagctccacgccatggaggtctagacttgccgggccttggatgcgggggtctggcgcccccgcaacatcc

SEQ ID NO: 113174 - DNA, 201 bp, Bos taurus
ctgaagcatcctggaggcagaaagctgtgttcagtcccgggccagagcatcaccaggcttcctccaaatgtgagacggcccagcccagcgcagggcttccwttctatttggaaatgaaagcagaagcacttctgtggctttgtcttctcttccccttgggaaccccacagatactatgggaagatttctggccaagtcaga

SEQ ID NO: 113175 - DNA, 201 bp, Bos taurus; identical to SEQ ID NO: 32227

SEQ ID NO: 113176 - DNA, 201 bp, Bos taurus
gacggatttgagaataaagagaagcaaacactccacgggatggtggccaccccagttacgtagccaagcctctttaggcttcagagaaaaaagcaagtccyaggatgagggctgagaggagatggccagcgtcaggccctgtcgcacactttaccacagtgaccacacaagggcaggccgagaccttctagagctgttgac

SEQ ID NO: 113177 - DNA, 201 bp, Bos taurus; identical to SEQ ID NO: 71938

SEQ ID NO: 113178 - DNA, 201 bp, Bos taurus
ggagaatgactcgcctgcccgcctccttcagctggagaaaaagccaacacacagcctagagggccggctgggcggggcggccgagaatgcagaccaggccytccagactagttctgaacacaggctccctacggctcctgggtggggagcacggttacaccgctccagccagcatcacatacacacctcacctggccccac

SEQ ID NO: 113179 - DNA, 201 bp, Bos taurus; identical to SEQ ID NO: 32233

SEQ ID NO: 113180 - DNA, 201 bp, Bos taurus; identical to SEQ ID NO: 71942

SEQ ID NO: 113181 - DNA, 201 bp, Bos taurus; identical to SEQ ID NO: 32237

SEQ ID NO: 113182 - DNA, 201 bp, Bos taurus; identical to SEQ ID NO: 32238

SEQ ID NO: 113183 - DNA, 201 bp, Bos taurus; identical to SEQ ID NO: 32241

SEQ ID NO: 113184 - DNA, 201 bp, Bos taurus
gtcactttggtttaatgatgttgaggtctcttcactcacatggaaagtaagaactggttttacttactgttgatttttttcccctcctgtggatgaaatarctgaaacctagaggaatgaaccagtgctactgaactgtttaaattattttcgtgttaatagtacactttgagtatctttttccacattaaaaaaatcttt

SEQ ID NO: 113185 - DNA, 201 bp, Bos taurus; identical to SEQ ID NO: 71951

SEQ ID NO: 113186 - DNA, 201 bp, Bos taurus; identical to SEQ ID NO: 71952

SEQ ID NO: 113187 - DNA, 201 bp, Bos taurus; identical to SEQ ID NO: 32242

SEQ ID NO: 113188 - DNA, 201 bp, Bos taurus; identical to SEQ ID NO: 32243

SEQ ID NO: 113189 - DNA, 201 bp, Bos taurus; identical to SEQ ID NO: 32244

SEQ ID NO: 113190 - DNA, 201 bp, Bos taurus
gcacttcccaggagtttgactttggattttgagcccctttccatcccatcagggaaacagagtgtgtgtctctttgggagttggggcatacatgtgttgayggggccttgaagtctgtttcttcccaggcccgcaccccatttctccagatcagctttgtgagggtccctgggtcctgctaagcaccctttcatttctggt

SEQ ID NO: 113191 - DNA, 201 bp, Bos taurus
agcctgtcttcgttaccgggcggccagcatgttgtgggcatctccaggggctttgttttgggggagaaaaccgcaatcagtggttttctgaaagggtgacktcgactcggaaaaggtgggcctagtgccaggcactgctgtccaagtctggaccggaagcctggaggaagagacagacgggtccttggatgccgggagtaa

SEQ ID NO: 113192 - DNA, 201 bp, Bos taurus; identical to SEQ ID NO: 32247

SEQ ID NO: 113193 - DNA, 201 bp, Bos taurus; identical to SEQ ID NO: 71962

SEQ ID NO: 113194 - DNA, 201 bp, Bos taurus; identical to SEQ ID NO: 71963

SEQ ID NO: 113195 - DNA, 201 bp, Bos taurus; identical to SEQ ID NO: 32250

SEQ ID NO: 113196 - DNA, 201 bp, Bos taurus
gccctgaatctttactttcggaagactcaggatcttggggaagagtcccaaggagaggacaggggaggctcagagcccctatggagacaaatagtcggccrctgactccctgtgtagccttgagtatatctcttcacctccccaagtctcagctgtatgtgtactcagtcattcagtaatgtccgactctgtgcaaccccg

SEQ ID NO: 113197 - DNA, 201 bp, Bos taurus; identical to SEQ ID NO: 71965

SEQ ID NO: 113198 - DNA, 201 bp, Bos taurus; identical to SEQ ID NO: 32253

SEQ ID NO: 113199 - DNA, 201 bp, Bos taurus; identical to SEQ ID NO: 71966

SEQ ID NO: 113200 - DNA, 201 bp, Bos taurus; identical to SEQ ID NO: 71967

SEQ ID NO: 113201 - DNA, 201 bp, Bos taurus; identical to SEQ ID NO: 71968

SEQ ID NO: 113202 - DNA, 201 bp, Bos taurus; identical to SEQ ID NO: 32254

SEQ ID NO: 113203 - DNA, 201 bp, Bos taurus
acagatgctgcagacagtgcaggcgccaggggctgactcaggtctgaaggccatcctgccaggaaacaggctgcctgctgaggagtgggctccccgtgacrggttacagctgtacaacgaacggatgctccctcctcccgaccaagccttcccccagcccgttctccccaacccggtctccctgtccttgagtctgtggac

SEQ ID NO: 113204 - DNA, 201 bp, Bos taurus; identical to SEQ ID NO: 32256

SEQ ID NO: 113205 - DNA, 201 bp, Bos taurus; identical to SEQ ID NO: 71971

SEQ ID NO: 113206 - DNA, 201 bp, Bos taurus; identical to SEQ ID NO: 32259

SEQ ID NO: 113207 - DNA, 201 bp, Bos taurus; identical to SEQ ID NO: 32260

SEQ ID NO: 113208 - DNA, 201 bp, Bos taurus; identical to SEQ ID NO: 32261

SEQ ID NO: 113209 - DNA, 201 bp, Bos taurus; identical to SEQ ID NO: 32262

SEQ ID NO: 113210 - DNA, 201 bp, Bos taurus; identical to SEQ ID NO: 32263

SEQ ID NO: 113211 - DNA, 201 bp, Bos taurus; identical to SEQ ID NO: 71979

SEQ ID NO: 113212 - DNA, 201 bp, Bos taurus; identical to SEQ ID NO: 32265

SEQ ID NO: 113213 - DNA, 201 bp, Bos taurus; identical to SEQ ID NO: 32266

SEQ ID NO: 113214 - DNA, 201 bp, Bos taurus; identical to SEQ ID NO: 32267

SEQ ID NO: 113215 - DNA, 201 bp, Bos taurus; identical to SEQ ID NO: 32268

SEQ ID NO: 113216 - DNA, 201 bp, Bos taurus; identical to SEQ ID NO: 32269

SEQ ID NO: 113217 - DNA, 201 bp, Bos taurus
ttagggctaatggccaaaaactgaggctcctgtcctcatgtctttgacaccctctgcaaagcaccagagacgagagatgccggtgtgagtggctttccctkggcttgcagtgggctgggacgggccatgccttcctgagcgccccctttcacctcagttgcagcctccgaacagacaaatcatgaatgagatggaatgttg

SEQ ID NO: 113218 - DNA, 201 bp, Bos taurus
ggaagatttgttgaggaaagcttgaaattattaggaaaaatgatgtgtctccagtccctgtggagtgtcgtgtcctctggccacagggtagtatggttttyccctgcctggagcccagatctcctcatgagaagatcagtgtccagcctggcctggtgctggtcattgcctgcctgtcttatcaggcggcactcagccagg

SEQ ID NO: 113219 - DNA, 201 bp, Bos taurus
ccaaggctcgctctaggtggttcctctggtgggtccagtagtgtttgtcttcatggagaaccagagaagtttgaggaggagagagaggctgcaggcacctrtgtaggaaaatgggcctggaagaaggggcccccacagaggctagcgtccctcagagggcagaattcagccacaggctactacctcacctctcagaaatgc

SEQ ID NO: 113220 - DNA, 201 bp, Bos taurus
gacatggggcatgggcctgaattcgggagcctgtgcagaccttgttgatatcaaccaggtcccctggggatgggtggctgttcaccacgcttttatcaggygacacctggccaggatgtgcgggtggctggggacccactcatctgtgaggggcctggcaagtggcagcctctgcagacgtcagagccgggagagggggct

SEQ ID NO: 113221 - DNA, 201 bp, Bos taurus
ctctgcagatgtccttcggccttctccgcgtgttctccattgtgatcccctttctctatgttgggacgctcattagcaagaactttgctgctctacttgargaacatgacatttttgttccagaggacgacgatgatgacgactaacaggtaagatttgcctctcccccacacatggaccaggagccggaagtagggtgga

SEQ ID NO: 113222 - DNA, 201 bp, Bos taurus
acagccccgcctcctgggggaaaagtctccgccctgccccgcccacacaggcctcgccctcctgtcctaaatgcctcccactttcacacccccttcagtcyggagactgctcccgttctctgtgggcccgcactgctcccgaggctcccctataggcgcccgtcttggctccactttgtattttactcactgagaccctgt

SEQ ID NO: 113223 - DNA, 201 bp, Bos taurus; identical to SEQ ID NO: 32272

SEQ ID NO: 113224 - DNA, 201 bp, Bos taurus; identical to SEQ ID NO: 71985

SEQ ID NO: 113225 - DNA, 201 bp, Bos taurus
ggctagcccagggccaggggcaggggccagggcagatccagatgctctgcagtgaaccagctgctggcagagaggctgagctgtgctccaagggaccaggrgctgtctcctgggcccccagctccttaggacagctctgagaaggggaggctctgatttaaagggtgtgcctgttttaaatctttgggagaaggtaaggga

SEQ ID NO: 113226 - DNA, 201 bp, Bos taurus; identical to SEQ ID NO: 32276

SEQ ID NO: 113227 - DNA, 201 bp, Bos taurus
tcagtttctcaaacagggcaacacatccctacccaccccgtcatggggctgctgtgaggatcaaatgagacaaacagccggccgcctccatcgggtcctcrtgcgttgagggattgactattacagtgatcacggtgaacatgaagtgtccttggctggattctgagctgctagaaagtgggcccatgccccccaccttgc

SEQ ID NO: 113228 - DNA, 201 bp, Bos taurus
ttgtcttgggacctccccttgggagaggagaattggcagatcgggctcccaagtgcggccccggggcccatcaggaggcctgtgcagaagcattgcccagracgaggctctggacgaatgaatgaatggatgagtgaatgactgaaaagtcagaggcggaggaaagggtggggtcctggccaccaggtgcacattcactgc

SEQ ID NO: 113229 - DNA, 201 bp, Bos taurus
agcctcagagtgcagagctgggctgcccacgggctttgaggccagggactacagaccattcgccccagagttctggcctccacacgctgcccagtgatgtkcgtgcccagaatttcaccaaaatgcactgaggaccctggagtcatcagcgagaaggagggttccctggggcggcccgtttggtccctcgcccgagtcacc

SEQ ID NO: 113230 - DNA, 201 bp, Bos taurus; identical to SEQ ID NO: 32277

SEQ ID NO: 113231 - DNA, 201 bp, Bos taurus
ttcagacatggcccgggaacttccctgggggtccagtggttaagaatctgccttgcaacgcaggggacactggtttgattcctggtctgggaaggtagccygtgggccgccactactgaagccagtgagtctagagcccacgctctgcagcaagagaagccaccacaatgagaagcccccacaccgcagtgaagagtagct

SEQ ID NO: 113232 - DNA, 201 bp, Bos taurus; identical to SEQ ID NO: 71990

SEQ ID NO: 113233 - DNA, 201 bp, Bos taurus; identical to SEQ ID NO: 32278

SEQ ID NO: 113234 - DNA, 201 bp, Bos taurus; identical to SEQ ID NO: 32279

SEQ ID NO: 113235 - DNA, 201 bp, Bos taurus; identical to SEQ ID NO: 32280

SEQ ID NO: 113236 - DNA, 201 bp, Bos taurus
acccgtggcacgtcctcctcaggccccacaggtgtgaccagcatagggatggaaaccacccagcaaagatccctctgctctctgatcaatgacacccctcrcggtgtttagggaaaggccttcatacttagacacaggaggcgtgtttccaactgttcgaaaaagtgtaagatgcatctgtaggatcacttttttttttct

SEQ ID NO: 113237 - DNA, 201 bp, Bos taurus
ctcggccgcccgtcaacaggaggatggagaggtgggcagggttcccgggaatgagaaggaacacgtgaccagtgtgcgcagcgccacgactctccaaaccrcagtgccgagcagaagaagccaggcccaaggagtgcacaccgtagccccgtttctcaggaggaggaggtctaaatgcacgcagctaatctctgctggttg

SEQ ID NO: 113238 - DNA, 201 bp, Bos taurus; identical to SEQ ID NO: 32286

SEQ ID NO: 113239 - DNA, 201 bp, Bos taurus; identical to SEQ ID NO: 71999

SEQ ID NO: 113240 - DNA, 201 bp, Bos taurus; identical to SEQ ID NO: 32288

SEQ ID NO: 113241 - DNA, 201 bp, Bos taurus; identical to SEQ ID NO: 32289

SEQ ID NO: 113242 - DNA, 201 bp, Bos taurus; identical to SEQ ID NO: 32290

SEQ ID NO: 113243 - DNA, 201 bp, Bos taurus; identical to SEQ ID NO: 32291

SEQ ID NO: 113244 - DNA, 201 bp, Bos taurus
gctggcagagacactgttcccacccccgtagggggcccggaggaaatgtgtagttcaaaagtgatctcggaaaaagccttgatggtgagcctttgagctartcttcggccactcctctggtgaccaggccacgggaaggcagaggggcgctgcacttttatgagccggggggcagagcgggaaccatccatctgtcctgca

SEQ ID NO: 113245 - DNA, 201 bp, Bos taurus; identical to SEQ ID NO: 32292

SEQ ID NO: 113246 - DNA, 201 bp, Bos taurus
tgcactctggatcctgttcttggcaaaacagggtcatctgccctgggagcagctgtctctggggacgtgatgagctcagtggctgaattactgaggcccaygggtgggagccagatcaaaccagtccaccctaaaggaaatcaaccctgaatattgactggaaggactgatgctgaagctgaagctccaatactttggcca

SEQ ID NO: 113247 - DNA, 201 bp, Bos taurus; identical to SEQ ID NO: 72005

SEQ ID NO: 113248 - DNA, 201 bp, Bos taurus; identical to SEQ ID NO: 72006

SEQ ID NO: 113249 - DNA, 201 bp, Bos taurus; identical to SEQ ID NO: 32296

SEQ ID NO: 113250 - DNA, 201 bp, Bos taurus; identical to SEQ ID NO: 72007

SEQ ID NO: 113251 - DNA, 201 bp, Bos taurus; identical to SEQ ID NO: 32297

SEQ ID NO: 113252 - DNA, 201 bp, Bos taurus; identical to SEQ ID NO: 32300

SEQ ID NO: 113253 - DNA, 201 bp, Bos taurus; identical to SEQ ID NO: 72012

SEQ ID NO: 113254 - DNA, 201 bp, Bos taurus; identical to SEQ ID NO: 32302

SEQ ID NO: 113255 - DNA, 201 bp, Bos taurus; identical to SEQ ID NO: 32308

SEQ ID NO: 113256 - DNA, 201 bp, Bos taurus; identical to SEQ ID NO: 32310

SEQ ID NO: 113257 - DNA, 201 bp, Bos taurus; identical to SEQ ID NO: 72021

SEQ ID NO: 113258 - DNA, 201 bp, Bos taurus; identical to SEQ ID NO: 72022

SEQ ID NO: 113259 - DNA, 201 bp, Bos taurus; identical to SEQ ID NO: 32312

SEQ ID NO: 113260 - DNA, 201 bp, Bos taurus; identical to SEQ ID NO: 32313

SEQ ID NO: 113261 - DNA, 201 bp, Bos taurus; identical to SEQ ID NO: 32314

SEQ ID NO: 113262 - DNA, 201 bp, Bos taurus; identical to SEQ ID NO: 72024

SEQ ID NO: 113263 - DNA, 201 bp, Bos taurus; identical to SEQ ID NO: 72025

SEQ ID NO: 113264 - DNA, 201 bp, Bos taurus; identical to SEQ ID NO: 72027

SEQ ID NO: 113265 - DNA, 201 bp, Bos taurus; identical to SEQ ID NO: 32319

SEQ ID NO: 113266 - DNA, 201 bp, Bos taurus; identical to SEQ ID NO: 32320

SEQ ID NO: 113267 - DNA, 201 bp, Bos taurus
tcctgacccaccaaattcgataggcctccctgctgcccacctgcagggtgtggaaaggacgtgcggtccacctcctcgtgtgggggacagtcacacactcyccccacggggcccggtcccagccgggttgtgacctgaggctgggcaggcgtggacaccgtccccaggaggggaaggactgctctccagcccctgcaggac

SEQ ID NO: 113268 - DNA, 201 bp, Bos taurus; identical to SEQ ID NO: 72030

SEQ ID NO: 113269 - DNA, 201 bp, Bos taurus; identical to SEQ ID NO: 72031

SEQ ID NO: 113270 - DNA, 201 bp, Bos taurus; identical to SEQ ID NO: 72032

SEQ ID NO: 113271 - DNA, 201 bp, Bos taurus; identical to SEQ ID NO: 32321

SEQ ID NO: 113272 - DNA, 201 bp, Bos taurus; identical to SEQ ID NO: 72034

SEQ ID NO: 113273 - DNA, 201 bp, Bos taurus; identical to SEQ ID NO: 32323

SEQ ID NO: 113274 - DNA, 201 bp, Bos taurus; identical to SEQ ID NO: 72037

SEQ ID NO: 113275 - DNA, 201 bp, Bos taurus; identical to SEQ ID NO: 72038

SEQ ID NO: 113276 - DNA, 201 bp, Bos taurus; identical to SEQ ID NO: 72039

SEQ ID NO: 113277 - DNA, 201 bp, Bos taurus; identical to SEQ ID NO: 32326

SEQ ID NO: 113278 - DNA, 201 bp, Bos taurus; identical to SEQ ID NO: 72041

SEQ ID NO: 113279 - DNA, 201 bp, Bos taurus; identical to SEQ ID NO: 32327

SEQ ID NO: 113280 - DNA, 201 bp, Bos taurus; identical to SEQ ID NO: 72043

SEQ ID NO: 113281 - DNA, 201 bp, Bos taurus; identical to SEQ ID NO: 32329

SEQ ID NO: 113282 - DNA, 201 bp, Bos taurus; identical to SEQ ID NO: 32331

SEQ ID NO: 113283 - DNA, 201 bp, Bos taurus
aatttacaaattaagagctgaaagtaatgattgcaaagatgttcaaaggacttgggagaagattagatgagcagagtgataagttagatgtgtttaaaaargagttaaagaatataaagcagaatgaaatacataatacaaaaactgaagtaaaaagacactaaaataactcaacagtcaactgacacagaacaaatcagt

SEQ ID NO: 113284 - DNA, 201 bp, Bos taurus; identical to SEQ ID NO: 32335

SEQ ID NO: 113285 - DNA, 201 bp, Bos taurus; identical to SEQ ID NO: 32336

SEQ ID NO: 113286 - DNA, 201 bp, Bos taurus; identical to SEQ ID NO: 32337

SEQ ID NO: 113287 - DNA, 201 bp, Bos taurus
gctaaaacaagagttacaacatagaggagaccccagcagcctgcacagactttagagaggaataaaatatagggtacatttttctcaacaaattgtcacgytcatgtcacaaagaaaatgaatgaaaactacagaaaaaaaaaaaaaaaggcactttttttttcccatcttgagcatttaattaagatagtaggttgcttt

SEQ ID NO: 113288 - DNA, 201 bp, Bos taurus
cctcaaaagaaattacttcctaactgtttccctgcccccacaacacaccagaaacaaatttagaaaatttttacttctttgttgactctctatactgagayattttacactgtattcttccaaccacagctattcattttgaagtcacgttaataaaagttatggatttgttgtgagaattaatgcaaaagaagtgtgtga

SEQ ID NO: 113289 - DNA, 201 bp, Bos taurus
aaagcagtaagttaataagtctcaaaaatttatattacattttttgtaattctgtatgttttgtttgttttaattgatgaaacttcaaataatgtaagaaraaatggataggtctccttgatttttatgtagaaacatcattgttcagccatccatcaaacttgtactgagtgactggccaaccccaaggacaagtgatgt

SEQ ID NO: 113290 - DNA, 201 bp, Bos taurus
ctgttttttttattttattttatttttaaactttacataattgtattagttttgccaaatatcaaaatgaatcaataattacatgctttttaaaggttttrtacctgttagaagttaattttctttcttgggagggcatattctattttagagttaaacaaatgtgttttatgtcttatcatttattgtttaccactttct

SEQ ID NO: 113291 - DNA, 201 bp, Bos taurus
aattcagaaatgtgaatcagacactttaatctgagtacttcagagaggagataaagcaaaggatataagggatgggtctgtcccaggaaggccccatagartcctactcagttacactatcggcatacaggaaggaaataataaataagtcagtcagttcagtcgctcagtcgcatctgactctttgcgaccccataaatc

SEQ ID NO: 113292 - DNA, 201 bp, Bos taurus; identical to SEQ ID NO: 72056

SEQ ID NO: 113293 - DNA, 201 bp, Bos taurus; identical to SEQ ID NO: 72057

SEQ ID NO: 113294 - DNA, 201 bp, Bos taurus; identical to SEQ ID NO: 72058

SEQ ID NO: 113295 - DNA, 201 bp, Bos taurus; identical to SEQ ID NO: 32341

SEQ ID NO: 113296 - DNA, 201 bp, Bos taurus; identical to SEQ ID NO: 32342

SEQ ID NO: 113297 - DNA, 201 bp, Bos taurus; identical to SEQ ID NO: 32344

SEQ ID NO: 113298 - DNA, 201 bp, Bos taurus
tcctggatatgaagaggattgttaaaacccatgagtactactttgctttactacttcatgctactcaactttgaagatgacttccaaattggccatgttgracctgacgacttttccagggaaaaaacgatgtggaacatttctgcactacagatatttcaaaaaatcaggccattattcatgatcattgtaatataatgc

SEQ ID NO: 113299 - DNA, 201 bp, Bos taurus
gagaaaaggagtactgaaagcatttcagctcatgacactggtgtttgctcaattctggctctatcttgaagtttaacttcagctttggaaatggatgcagycttggaaatggaaatggaaattttatcgcaagatacttttgtgtaatgtgtgaattagagatggtttagttggcaatgatttcagaaatacatgtttagc

SEQ ID NO: 113300 - DNA, 201 bp, Bos taurus; identical to SEQ ID NO: 32345

SEQ ID NO: 113301 - DNA, 201 bp, Bos taurus; identical to SEQ ID NO: 32346

SEQ ID NO: 113302 - DNA, 201 bp, Bos taurus; identical to SEQ ID NO: 32350

SEQ ID NO: 113303 - DNA, 201 bp, Bos taurus; identical to SEQ ID NO: 32351

SEQ ID NO: 113304 - DNA, 201 bp, Bos taurus
tgtttcctgaatacataactccatgaagttctgggttttaactccttgtgaatgtgtctcacttacattgaactgcatctacagcatgaccctgacttacraacaaattatatggagtacaagaaaatcattaaaagcactcaagattatgtagatccaatattctactgcctagcccttgacattctaccccttagtaaa

SEQ ID NO: 113305 - DNA, 201 bp, Bos taurus; identical to SEQ ID NO: 72067

SEQ ID NO: 113306 - DNA, 201 bp, Bos taurus; identical to SEQ ID NO: 32355

SEQ ID NO: 113307 - DNA, 201 bp, Bos taurus; identical to SEQ ID NO: 32356

SEQ ID NO: 113308 - DNA, 201 bp, Bos taurus; identical to SEQ ID NO: 32357

SEQ ID NO: 113309 - DNA, 201 bp, Bos taurus; identical to SEQ ID NO: 72073

SEQ ID NO: 113310 - DNA, 201 bp, Bos taurus; identical to SEQ ID NO: 72075

SEQ ID NO: 113311 - DNA, 201 bp, Bos taurus; identical to SEQ ID NO: 72076

SEQ ID NO: 113312 - DNA, 201 bp, Bos taurus; identical to SEQ ID NO: 32362

SEQ ID NO: 113313 - DNA, 201 bp, Bos taurus
ttcaatattaaaaacattcaagcaaaaaatgtgtagaagacataaatagaaatttttccaaagaagacatacagatggccaacagacacatgagaagatgygcaacactgctaattgttgttgatcagtcagtcagtcatgtctgactttttgagaccccatggcctgcagcacgtcatgcttccctgtccttcactatct

SEQ ID NO: 113314 - DNA, 201 bp, Bos taurus
taacgtgttagttccaggacagccctgctccggcgcaacaacatgtaggtgccagtgttgcaatgcctcaagctaggcaactaactggccagggacacagmctcacccattagcagacaggctgccttatgattccctaagccaacagcaacctctagacatggccctgcccaccagagggctcaggactctgcttcaccc

SEQ ID NO: 113315 - DNA, 201 bp, Bos taurus; identical to SEQ ID NO: 32364

SEQ ID NO: 113316 - DNA, 201 bp, Bos taurus; identical to SEQ ID NO: 32365

SEQ ID NO: 113317 - DNA, 201 bp, Bos taurus
cattatttaaaaagcaagccggggacttccctggtggcccagtggttaagatttcatcttccaatgcaaggagtacaggtttgatccctggtcagagaackaaggtcccacacacctccaggccgaaaaactaaaacataaatcagaaacaatactgtaacagattcaataaaaacttggaaagaaatggtctacatcaaa

SEQ ID NO: 113318 - DNA, 201 bp, Bos taurus; identical to SEQ ID NO: 32366

SEQ ID NO: 113319 - DNA, 201 bp, Bos taurus
acaaaaaaatcattatgtgaaagtagaaacatgtttctgatcaacatgagaaaagcctttctggcagagagttcctattgtgggcaatgtttgagttaagytgggtgaaggtaggagctttgctggaaagggtgttcctctcccagttggaaactggcacagtggatctatgtgaaaacttctgtgtcttcttccatgtac

SEQ ID NO: 113320 - DNA, 201 bp, Bos taurus; identical to SEQ ID NO: 72091

SEQ ID NO: 113321 - DNA, 201 bp, Bos taurus
agggccacacggaatcctgctcttgccccttgcagccaagtccccgtgcagagagcagtgtccctggaacaccaaccaggaagatctctgcctctgaattygatcggccgcttagacccatcgttatcaaggattctgagggaactgtgagcttcctctctgactcagacaagaaggaacagatgcctctaacctccccac

SEQ ID NO: 113322 - DNA, 201 bp, Bos taurus; identical to SEQ ID NO: 32372

SEQ ID NO: 113323 - DNA, 201 bp, Bos taurus; identical to SEQ ID NO: 32374

SEQ ID NO: 113324 - DNA, 201 bp, Bos taurus; identical to SEQ ID NO: 32375

SEQ ID NO: 113325 - DNA, 201 bp, Bos taurus; identical to SEQ ID NO: 32376

SEQ ID NO: 113326 - DNA, 201 bp, Bos taurus
ggctttaataccattccttgtttggtgacagagtatgctattcattgacaggcaatatcacagtgaacagaggctgattctcagagtttcaggccatcttmtctggatactagtacaatcattattgggcaatgagaagcaatgaaagagctggcttcctttccccttcctttctcactttcacagtttattttaacctgt

SEQ ID NO: 113327 - DNA, 201 bp, Bos taurus; identical to SEQ ID NO: 32377

SEQ ID NO: 113328 - DNA, 201 bp, Bos taurus; identical to SEQ ID NO: 32378

SEQ ID NO: 113329 - DNA, 201 bp, Bos taurus; identical to SEQ ID NO: 32379

SEQ ID NO: 113330 - DNA, 201 bp, Bos taurus
gccacacaggaccagagccaagaagagccaaatgagggttttagagtgaggctccccatcccttcacttttttccatttaagaaaagaacagaaaagaaaragcaggcaggaatatactagaggccaaaagagtaaaaaacacacttataaacaaaattgcaaaatctgaaaatatttctgaggtaagtgtaatataatgt

SEQ ID NO: 113331 - DNA, 201 bp, Bos taurus; identical to SEQ ID NO: 72103

SEQ ID NO: 113332 - DNA, 201 bp, Bos taurus; identical to SEQ ID NO: 72104

SEQ ID NO: 113333 - DNA, 201 bp, Bos taurus; identical to SEQ ID NO: 72105

SEQ ID NO: 113334 - DNA, 201 bp, Bos taurus
gttaaagctgccacaatcagaatgggtgaggctgtgttgcagttacaaacagtccaaagtctcagtggcttaaaatcagaaaggtttgtttctcgccatgytcttggccatttacggactcagaccagtgagactttcacgtttgtaatgtttctaggcaacatgaaaggagaagggaaggcagagaatcaatcacacttg

SEQ ID NO: 113335 - DNA, 201 bp, Bos taurus; identical to SEQ ID NO: 32383

SEQ ID NO: 113336 - DNA, 201 bp, Bos taurus; identical to SEQ ID NO: 32388

SEQ ID NO: 113337 - DNA, 201 bp, Bos taurus; identical to SEQ ID NO: 32389

SEQ ID NO: 113338 - DNA, 201 bp, Bos taurus; identical to SEQ ID NO: 32390

SEQ ID NO: 113339 - DNA, 201 bp, Bos taurus
aaaggaaaacaaaacaaaacaaaacagaggaagcatctactccttttattctttcttctttattttactcccttctatatgcaggtgctttcctaaaccaygaggatgagagagacacgccaggaatgacagagcagtgaactggaaatattgtggtccttgtgcacacacgccttagatgactttcctctgaacccatat

SEQ ID NO: 113340 - DNA, 201 bp, Bos taurus
ggatttgatttcacagaacagaatatatccattagagaataaaaacagcagtgtatacaactgtaaattatgtgttgtatatatgttgtcctctgttttgkacaacaaaatgaggtgaaataattttagggcagggattctcctattctttctttttgcttaattaattagaagtgatgttacttattatttctcttcaaa

SEQ ID NO: 113341 - DNA, 201 bp, Bos taurus
aaggatctgtgaggatggtaacagagagcatcaatacagtaaagaatgtgaaaaaaataagttaccaatggctttgagctgcttcctgttaccctattaayatgtggacaattttaagacagaaatccaaaatttagtggccggggaaatctttatgaatgaccgtgttaggatctcttctatctcaaggattttggaaga

SEQ ID NO: 113342 - DNA, 201 bp, Bos taurus
ccctttgtgttatagccacagtacatttgtactacctttggtacaaaataccaatatttttctgcataacatacttgattttatggtttaaattgccacaractagatatcattcttctcaaaacatacacattcatttaactatctatataaatgattttatttagaaaaccctatgaaattaatatgaatttaaaataa

SEQ ID NO: 113343 - DNA, 201 bp, Bos taurus
agtctcttattttttccccttttctcacaatttgcatcaacaacaacaaagatgacatgctaagaactgtgtaaaatcatatttgttgagtgaaatggaarcaattgaggaaaacagaaatcttctccttagttattttaccttgcaacatatattatagagattctgaaaagattttcacaatattatatattccataaa

SEQ ID NO: 113344 - DNA, 201 bp, Bos taurus
attctaaacaaaagcaacatagcacagtaaaagaaaaacaaaattttaagttaattcaactcacttatttaaatggtagcctttgagattttagaagacakaaaattttaactttgtctattatttaatgctaattcattatataacattttaacaatgagtttcatctaaaagcaaagtttcttttagtgttttctcttt

SEQ ID NO: 113345 - DNA, 201 bp, Bos taurus; identical to SEQ ID NO: 32392

SEQ ID NO: 113346 - DNA, 201 bp, Bos taurus; identical to SEQ ID NO: 32393

SEQ ID NO: 113347 - DNA, 201 bp, Bos taurus; identical to SEQ ID NO: 32394

SEQ ID NO: 113348 - DNA, 201 bp, Bos taurus; identical to SEQ ID NO: 32395

SEQ ID NO: 113349 - DNA, 201 bp, Bos taurus; identical to SEQ ID NO: 72115

SEQ ID NO: 113350 - DNA, 201 bp, Bos taurus; identical to SEQ ID NO: 72116

SEQ ID NO: 113351 - DNA, 201 bp, Bos taurus; identical to SEQ ID NO: 72117

SEQ ID NO: 113352 - DNA, 201 bp, Bos taurus; identical to SEQ ID NO: 72118

SEQ ID NO: 113353 - DNA, 201 bp, Bos taurus; identical to SEQ ID NO: 72119

SEQ ID NO: 113354 - DNA, 201 bp, Bos taurus; identical to SEQ ID NO: 72120

SEQ ID NO: 113355 - DNA, 201 bp, Bos taurus; identical to SEQ ID NO: 72121

SEQ ID NO: 113356 - DNA, 201 bp, Bos taurus; identical to SEQ ID NO: 72123

SEQ ID NO: 113357 - DNA, 201 bp, Bos taurus; identical to SEQ ID NO: 72124

SEQ ID NO: 113358 - DNA, 201 bp, Bos taurus; identical to SEQ ID NO: 72125

SEQ ID NO: 113359 - DNA, 201 bp, Bos taurus; identical to SEQ ID NO: 72126

SEQ ID NO: 113360 - DNA, 201 bp, Bos taurus; identical to SEQ ID NO: 72127

SEQ ID NO: 113361 - DNA, 201 bp, Bos taurus; identical to SEQ ID NO: 72128

SEQ ID NO: 113362 - DNA, 201 bp, Bos taurus; identical to SEQ ID NO: 72129

SEQ ID NO: 113363 - DNA, 201 bp, Bos taurus; identical to SEQ ID NO: 72130

SEQ ID NO: 113364 - DNA, 201 bp, Bos taurus; identical to SEQ ID NO: 72131

SEQ ID NO: 113365 - DNA, 201 bp, Bos taurus; identical to SEQ ID NO: 72132

SEQ ID NO: 113366 - DNA, 201 bp, Bos taurus; identical to SEQ ID NO: 72133

SEQ ID NO: 113367 - DNA, 201 bp, Bos taurus; identical to SEQ ID NO: 72134

SEQ ID NO: 113368 - DNA, 201 bp, Bos taurus; identical to SEQ ID NO: 72135

SEQ ID NO: 113369 - DNA, 201 bp, Bos taurus; identical to SEQ ID NO: 72136

SEQ ID NO: 113370 - DNA, 201 bp, Bos taurus; identical to SEQ ID NO: 72137

SEQ ID NO: 113371 - DNA, 201 bp, Bos taurus; identical to SEQ ID NO: 72138

SEQ ID NO: 113372 - DNA, 201 bp, Bos taurus
ctatttgtttacaaaactgtagaggtctattatagaatgatcaatgatatctatttttttaattactacaaacaattctgatgattagatataaaaatatmtgagtacttctgagtactgacaaaatttgttcttgacaaggtttattcttttggatttctgttctcctatttcactaaactgtgttctattctgctattg

SEQ ID NO: 113373 - DNA, 201 bp, Bos taurus; identical to SEQ ID NO: 72144

SEQ ID NO: 113374 - DNA, 201 bp, Bos taurus
actgctaataagctgattgcccttgaaaacagcagacacctctttagtgctcttgggactattataggagtagtttgtcaagaatttggcccaagagatcwaacatgccctaaaaaatatttaccatatgactttcatgtgtatttgtggaaaagaatgagtggttgacttaacgttaaagttaactacataaaattagat

SEQ ID NO: 113375 - DNA, 201 bp, Bos taurus
ctgagtaaagaaagagggttggttgtctgtcttactcttgcttctgtaataggcttgtcctgtcctcagtgattcttttgagggcctctgggagcccttcyctggagcaaggattgccaaactttttctatgaagcacccaataggaaatattttagactttgctggccatgccttcttttgtcctaactgttctgacttt

SEQ ID NO: 113376 - DNA, 201 bp, Bos taurus
tataatcattcatatcgattatacttcatataaataattttgaatcatgtgtatataggacacaatgaagtgaactgagaaattaaaaatgcttctgcttmtatatcctatatacattttctccaactggtgtgaccttgtttgactcttcacattaggtttgctttgagaagtcattttccaaaattcaccagtctagta

SEQ ID NO: 113377 - DNA, 201 bp, Bos taurus; identical to SEQ ID NO: 72152

SEQ ID NO: 113378 - DNA, 201 bp, Bos taurus
gtacttttttgagtacatatgttatataatattaacatctactccagaagagaataagaatttgaattccttactttctagtatcatttttgtcccaagaygatattttaattctataggaataacagacctaagaactctatttgtgccactcttggcatttctgtttttttagaaatctttctaattactgggtgtcag

SEQ ID NO: 113379 - DNA, 201 bp, Bos taurus; identical to SEQ ID NO: 72153

SEQ ID NO: 113380 - DNA, 201 bp, Bos taurus; identical to SEQ ID NO: 72154

SEQ ID NO: 113381 - DNA, 201 bp, Bos taurus; identical to SEQ ID NO: 72155

SEQ ID NO: 113382 - DNA, 201 bp, Bos taurus
actacatgttagaactgacctgcttgtcttcaattttatttcctatcttttctctacataaatctttgtagagctgaaccactcattaaataaatccccayatttattttggcctgctagcaaaagtattattggatttccctaaacttctgtaactgcctcatcctctgataatttattaccacttactgtctgtagcaa

SEQ ID NO: 113383 - DNA, 201 bp, Bos taurus
gacagggaggcctggcttgctgcagtccatggggtcgcaaagagtcagacatgactgagcaactcaacagcgagcagcatggctagagagctagagagacrcaggagaaggccagaaaatgatcatcaccttagtttcctttttctcctatatgctgcacattcagtaggttttactttgtatgcctcaaacaattgtctt

SEQ ID NO: 113384 - DNA, 201 bp, Bos taurus
ttctttgtgtgtgtgttttcagaattcctttctatctgtgcaggattagtggtttcccagctttgtaagattttatcatcctttttgtcccgttccctttktgacttcctaaagcatctctgaaataagtctggctttccctgccccactgctggctgtttgccagtactgtactggatttggatttcatatttcttctgt

SEQ ID NO: 113385 - DNA, 201 bp, Bos taurus
aggccaaccagaatcagaagtccaagaagcagaacaaaataagggtctggaatgagcagaagtatttctggaccccacattttcaacttcctgcatgcctyctttaaaccaccctccaccagaggccaatgaagtgcctgttgtgctgtgaggtgggaaggttgccaagggcgtggacttgtgcagctgacattgagaaga

SEQ ID NO: 113386 - DNA, 201 bp, Bos taurus
gtatctaataaagtctaattctctaaccgttttctttggaactccttctgaaggaagaactgttgttgatgtctgtaagggaggaatgcagggggccacgmaaaggctgtgaattcagacgcatcctgctgtgtgcatgctggctccattctccctttgttcctacctccacacggcggcaggtggccaacagtagctccc

SEQ ID NO: 113387 - DNA, 201 bp, Bos taurus; identical to SEQ ID NO: 72157

SEQ ID NO: 113388 - DNA, 201 bp, Bos taurus; identical to SEQ ID NO: 72159

SEQ ID NO: 113389 - DNA, 201 bp, Bos taurus
tttgaagcaaattttttactttctccacttctttctccagagaatctggaaactaatgaaaaagagaatgcatccttaaggagaaatgcatactgtcaaarcactgctctctggacttcctttgcaggtacttctgaggttagtgaggttagtgggctttcctagtggctcagatggtaaaaaaaaaaaaatccacctgca

SEQ ID NO: 113390 - DNA, 201 bp, Bos taurus
tcagaggatgctgattagagaatttgaattactctgtcttacttttaactgtataccttgggaagagttgcatctctagggttcaacttctttatccataraatggtctgaaattaacagcctctcagacagcaccgaggggccctgtctctggtattcatacctttggtagtcccctctccttgaatgtgggctggactg

SEQ ID NO: 113391 - DNA, 201 bp, Bos taurus
ggaagcaggaagacctgctgatttaaccccaacttccctttctgtaatccacagtaaatagggaggatgtgagcaggctaactgttttaatcaggcctggrtcctttgaaatctgtttcatatacagctttaagaactcaggttatgaacatcctgatgtaaaatcagatggcagttcttccaaaatgtgggccctaaaga

SEQ ID NO: 113392 - DNA, 201 bp, Bos taurus
ctatatttgcaaatgcaggcctcatcactgaattaactggctatcatcaatgtatttaacacatctcatgcagacttctctccaaatgactgagaaatccraggtgacttcacaatggcaatctcaaaaactgggttatttacaaggttgcctgactgagggcagcttcaaacctctaaaccccttgcaagcatcatgcct

SEQ ID NO: 113393 - DNA, 201 bp, Bos taurus
cgctggtatccaaggaaagcaattctccttaatcaagtcgtattttcttagtgtatcctaggctctaacccagggaacttccctaaggccctggtgagaartgcagaaagacaaggagaaattctaaaaagaggaataacaatgtgactagatgtgtattttagaaagacacctctggaagcaaggtggttaagatagcca

SEQ ID NO: 113394 - DNA, 201 bp, Bos taurus
tttaaatattctttccagaacaaaacagtaagatttcattttcttatttcatttcttagcccatccaacaaatttggtattgaaatctatgcaaaggtacygaaggggacactgttcaagtgcctatggaaaaaacaatgatgaacaaagagagcgcttgccctcacaggctttactgtgggaggtgcattttccatcttt

SEQ ID NO: 113395 - DNA, 201 bp, Bos taurus
tgcacccaagaaagattagcttattacatgtctccaacagttgcactggacccctgaatgttcactttggaagaagctgaagttgaagctgaagttgtatraagacctacaagaccttctagaactaacatccaaaaaggatgtcctcttcattacaggggactggaatgcaaaagtaggaagtcaagagctatctggagt

SEQ ID NO: 113396 - DNA, 201 bp, Bos taurus
gcacgcgctgtccctcacggaggacagagtgaagggtgctttcccctcataccagcctagaaaagaggttttaatgcaaccacttgaagagttttatctgygtatcctggaactcatgtggacacagtggcctggtatctgatccccaagaaatctagaggatgagagactgtagttgactactgctttaacatcagagtg

SEQ ID NO: 113397 - DNA, 201 bp, Bos taurus
agcatgcttatttacatagttatctgtgtggctgtcattttgacttaaatctgggaacattttatgtctgaattggatttaatcttgtaaacctgaaatcyggtttccattccattgtgaacaatcatatgcttttcatagtgttttcatttctggttttagtctccagcgctgagataaacctattatccacagaacatt

SEQ ID NO: 113398 - DNA, 201 bp, Bos taurus
acttaattgcacagaatattagatgcatgtaaaccttaaggcatgagtcgtgttctctcactattaacaaaaagctagtcgagactttaaagaaattgtaygaagcagtccaaaaactattacacaaataatacttaactagcagttctttgattaaatgttagttaagtaacttaaaagaagtgttttgagcataatttt

SEQ ID NO: 113399 - DNA, 201 bp, Bos taurus
gttttaaatgcctcagatggtcctcactcttaaatcatactgacatttctgttaaaaataaaacagccctgaagtcacacaattactttctagaatcctaragttcctttaagatctttcctagtaggttttaacttttttagtttccatccattgaaatattttgccaataaataacttcattattttacacatttcatc

SEQ ID NO: 113400 - DNA, 201 bp, Bos taurus
gcaccttggcctgcccgacgagtgcggccgcactgcaagcactgcaagcactgcacaggcgttgccttgccccgcctgtgacggccagacgctcacgcctrtaagctccagattcaccctctttcactgctctatgaacatgaacctgagttctttcactgtttttcctttgatggttggccctcaagttctgtgagtggg

SEQ ID NO: 113401 - DNA, 201 bp, Bos taurus
aagtacgtcatttagaggcctccacactgatggaattctagtagtgacctgagaatactcctcttccctattctgcctccaggcccaaggctttggctttyaacaattaagagtcacaaaggactttgtgcccaataagaatacatattattttcaagctcatatggaagagtcacaatgtaatgaccataattgaggcct

SEQ ID NO: 113402 - DNA, 201 bp, Bos taurus
agtgatctaaaaagagactgtggccatatgatacaaaagataatccccctaccttgatttagtgctagtattggtgggcatatttttagtattagcatccrcaactcaagttctcctaaggcccgaatgagaggctccagcactccctattgggatgattttatggaacagaaatttctgatttaatctattattttcaac

SEQ ID NO: 113403 - DNA, 201 bp, Bos taurus
ccctgggtgtatgtatatatagtgtgtgtatatatatatatatacacgcacacatatgcatagtatatatacactccacatctttatctatttgtcaatcrgtgggcacttaagttgctttgataccttggctattacaaataatgctacagtaagtcttggtgttcatgtatctttttgaattaattgttttctttgagt

SEQ ID NO: 113404 - DNA, 201 bp, Bos taurus
ggagaaaatactgaattcttagtaaatggttcaactaatgttaaatcttacccaaaacaatcgagttggcattgtacaactcaaagacattaaacataatraactcatgattgaaaagagaaatgaccgataaaattgaaagagaatattttttcctgaggaaaaaaaatttttcatacaatctcttggttttccattttt

SEQ ID NO: 113405 - DNA, 201 bp, Bos taurus
tactcctaccagcctctgaaccaagatcctgaacaagaggaggtggaactggcaccagtgggggatggagaagatgtagttgctgatattcaagatcggayccaggccctggggcttcattcgcctgccggacccaccactagaaagtgaggacgaagatgagcagggagatacaacattgaacaaccacagctctattcc

SEQ ID NO: 113406 - DNA, 201 bp, Bos taurus
gcgtgtggagcacacgttctggtgggggcccgagagctcggggagaggagtgggggaggggcggcgcctccggcggagccttaagaccacgaggatggagrgtgttcggggccctgggctagggttgtgagaattgtgttttcgggataggagggcgcggggccggctccgagcaggcatcgggatccgcagggagggtgg

SEQ ID NO: 113407 - DNA, 201 bp, Bos taurus
acgtgtcctgatgaattttgcctcttgcttgctgatttggtaaagaagtgtggactcaagttcatggtgccactagtttgtgattcagtctcaggataccyctgttcctgggccctggaaccacggggaactgagtcagcagtgtcagcctcattcagttttggggcttgaacatacgcttcaggataggagctcagcaga

SEQ ID NO: 113408 - DNA, 201 bp, Bos taurus
tttctctgtactcaatcataaacccgagcctgggtcaggagctcacagccgctcatgaagtttcagatatttgtgtgggagtgaagtttacttcctcctargatcctgcaaaggagaaggcagtggcaccccactccagtactcttgcctggagaatcccatgggcagaggagcctggtgggctgcagtccatggggtcgc

SEQ ID NO: 113409 - DNA, 201 bp, Bos taurus
tggtttgctgggtgatttaaaaatatatatattgcaagccctgcacaaagaaataataattcttgctgaagttcaggatttctgtggaggcccacaagggrttcttggaggaaacacatgatggagcaggctttctggtagaagggttgttcaacgcattccttctaagccttgtggccttggaataagctgcagaaccaa

SEQ ID NO: 113410 - DNA, 201 bp, Bos taurus
ttaaacaatggtgaaaagatgaagacctgaggcagtacatccctccctcctgtagggattctgtcggtggaatcacacctccgtggggcccttgttgcagyggtcgtctctggtgctgattcagtgagggggtccttttccactggtctttgaggtctttgtgggacaggacctgaatgaggtttcattccaggtcttgac

SEQ ID NO: 113411 - DNA, 201 bp, Bos taurus
cttcctgccagggcagaaatgtgggtgcagctttgctctctgagcctggcaggtggtaaaggggatggtgccttggcccttttgaagtttccccaaggtcyctctgccttgcagttcccttcctctgggtgggcatccctgttctaggtggccacccagtacccctgcccagacctggtgtctccgagcttcctcagagat

SEQ ID NO: 113412 - DNA, 201 bp, Bos taurus
gactcaaggccccaaacgatggtacttatctacagtttcttgcagacaaagaatacaaatagcaacaacattaaagtattctttgtcatcaaaggctgcargggttccagagagatcaggagtgagctctaatggtcttctctccataaggccatatcaggacacgctttctgtcttagatcaggaactgctaacagatgt

SEQ ID NO: 113413 - DNA, 201 bp, Bos taurus; identical to SEQ ID NO: 32426

SEQ ID NO: 113414 - DNA, 201 bp, Bos taurus
ctcctggatttttccccttcaggttactacaggttgaccaaattcttctactgaagaataggccaatctattgtaggccctttccatacaactgtactatrtaggttctagaaattaacacttctccttgccccttcagatacagttgtcataacatctatccaatgtcacgaggcctaggatacatcattcctggttagt

SEQ ID NO: 113415 - DNA, 201 bp, Bos taurus; identical to SEQ ID NO: 32427

SEQ ID NO: 113416 - DNA, 201 bp, Bos taurus; identical to SEQ ID NO: 32432

SEQ ID NO: 113417 - DNA, 201 bp, Bos taurus
ccatctcctctgcacttggacaaatgggcaggcatcaatctggagatgtgtgttacagcccagtcttcactgtaggctttctatataaaatttaatacctraaaggccataagccaggcaggacttactccctcactaagaaaacatatcattctgtccttgaagtaccagaggggctgtgtgatcctccagagggcaggg

SEQ ID NO: 113418 - DNA, 201 bp, Bos taurus; identical to SEQ ID NO: 32435

SEQ ID NO: 113419 - DNA, 201 bp, Bos taurus; identical to SEQ ID NO: 32436

SEQ ID NO: 113420 - DNA, 201 bp, Bos taurus; identical to SEQ ID NO: 32438

SEQ ID NO: 113421 - DNA, 201 bp, Bos taurus; identical to SEQ ID NO: 32439

SEQ ID NO: 113422 - DNA, 201 bp, Bos taurus; identical to SEQ ID NO: 32440

SEQ ID NO: 113423 - DNA, 201 bp, Bos taurus; identical to SEQ ID NO: 32441

SEQ ID NO: 113424 - DNA, 201 bp, Bos taurus; identical to SEQ ID NO: 32442

SEQ ID NO: 113425 - DNA, 201 bp, Bos taurus; identical to SEQ ID NO: 32443

SEQ ID NO: 113426 - DNA, 201 bp, Bos taurus; identical to SEQ ID NO: 32444

SEQ ID NO: 113427 - DNA, 201 bp, Bos taurus; identical to SEQ ID NO: 32445

SEQ ID NO: 113428 - DNA, 201 bp, Bos taurus
gaattttaattttcattactgtaaacttttcaatcattctagaaatcacttgagactgctctttaaagatgttttaagagctctgtagtagggaaatgtaygtcctttctaaatgagaaagaactagctcccagaaacagtttgtctctatgagaagtgaacctataatggctgttctccaagcaattctgtgtggcatta

SEQ ID NO: 113429 - DNA, 201 bp, Bos taurus
tcaatacagcatatgccactgtcactcaggaaaagggcaccagtctgcagtaccagccatcccctctcagggtctttcactacatatactgtcaggccaayatcactgaaacccttcccaggcgtgcactggtcccagggaaccaggctgtacccatactgcagcagctgggacttgctggccccagggttgccacacagc

SEQ ID NO: 113430 - DNA, 201 bp, Bos taurus
attgagccttcaaatgtggactgtaaagggcatactgatgctattatagagagaactgggaaagcataaaaataatgctgaatggtaatgcagaaatgtayagaagacattctgagtttaataagcaaattctagctagcattttctagaatatattggatgaagataaacttttatagaaatattattgataaataaaat

SEQ ID NO: 113431 - DNA, 201 bp, Bos taurus
agggcaaacatctaattgccaaatgtatgttattattatcctgtcaattaccctctgtctctttgaagatccctaccccattccattcagttcaggatgaygtataagcctcaactgcctgacttgcccttgtgtctcatatttttatggggctcccatacgtatgaaattaaactcttttttatcctattaatctgtctt

SEQ ID NO: 113432 - DNA, 201 bp, Bos taurus; identical to SEQ ID NO: 32446

SEQ ID NO: 113433 - DNA, 201 bp, Bos taurus
atttcttttttcatagatgtgataaatatctatacatgatttttgtttgtttcagatatctgcctccttcaggtaaagatttgaggtcatttacagaaatycattctgtacaatataaaagaggaaaaatattaacagaaaaatatggctgtggttagctttgaggacctgttggaaattggtaaaaaatcctactcaaca

SEQ ID NO: 113434 - DNA, 201 bp, Bos taurus; identical to SEQ ID NO: 32447

SEQ ID NO: 113435 - DNA, 201 bp, Bos taurus; identical to SEQ ID NO: 32448

SEQ ID NO: 113436 - DNA, 201 bp, Bos taurus; identical to SEQ ID NO: 32449

SEQ ID NO: 113437 - DNA, 201 bp, Bos taurus
gcagtggttaaaactaatgtacagtcagtatgagaagcagcagtctaagaattacctgcagaatctcctgaacaagcatttcttctgtaataaatacataygtagctccaagcctatttctccaggcatcttcacttatccctgaatataaggtttcctacaggcaggcctgcttatcttttgcttatctcaccttacttt

SEQ ID NO: 113438 - DNA, 201 bp, Bos taurus
gagagttcaataattctgactctaataattcagggtttaccaaaatgtgataaagatcaagataatactgatcttggagggaatgagaaagaaaattcttygcaaacttacaagtaagactggtcttcccaaactcaatctccacacaaactagaatgaacatgaaataaccaatgcttacatctacataataagcagatt

SEQ ID NO: 113439 - DNA, 201 bp, Bos taurus
gagctcgtgttctaaatatttttgtggcttcagaatctgaaggaagaaacagtttctttgatgtagacactctcttctggggaaaattctggttttgcttkactagaaacacattctaaaatgaaataggtttcacatgaatgctctcattgctctactaccagaaaagtgatttttaaatactcttcacactttctgtat

SEQ ID NO: 113440 - DNA, 201 bp, Bos taurus
ggcaaaatattcctaacatatgtatataatgctctcttgtcttcggttcctaggccaggattcttatgcatatgtttcaaaatctaatcactatgcctacrtcactggatgttcaacagtaacactataatgatggtgacttgtttgacttttgagcacttttaagacaaaaggcctggaatttacaagaataagtgattt

SEQ ID NO: 113441 - DNA, 201 bp, Bos taurus; identical to SEQ ID NO: 32453

SEQ ID NO: 113442 - DNA, 201 bp, Bos taurus
agtaactatggtgtatttttatctgttatattaacagtaaaatactagagagagatgggggagtgacagagaaaaagggatgaaggagggaaagctgaggrtgggagagaaagagagagaaggaatgtactaagacccttcataacaaggataacagcttaaaatactttctgaagcaaatttatcccaggaagagtagat

SEQ ID NO: 113443 - DNA, 201 bp, Bos taurus
atctgacatttcttaacagggcaggggaaaggctcctctgatgattcctgctcaccatgacaaccacaaatctgcagatcacaggtgaggagggtagcctrtctctgaacaaagcaatctgtgtgggaagtgagttgaggagagagctgagaagagcagtggaagagatgaggaatgggttggaaagaggatgcagagaca

SEQ ID NO: 113444 - DNA, 201 bp, Bos taurus
atagtcattgaaacagttaagaaatagaagttactccataaatgtttcttgagaaaaataaaatcagcctatatgtaattttatataactttaaatcccayaaaaagaattttatggaatttcacttaaagagtgcttaaaatacaggaaatgaaaaatatgaaacaggatggcagaattaaatcctagttataatttaaa

SEQ ID NO: 113445 - DNA, 201 bp, Bos taurus
tcatattagctttataggtactgaaaaatacaagtatagtatttactgttcagccactcacctatctattcatccatttctttgatccatatttgttaaartcatgccatgtgtaaaatactgtgccaggcatcatcagaaatatggggatataggagaccaatttcttctgctttaggcattgacatctagctgttaatc

SEQ ID NO: 113446 - DNA, 201 bp, Bos taurus; identical to SEQ ID NO: 32464

SEQ ID NO: 113447 - DNA, 201 bp, Bos taurus; identical to SEQ ID NO: 32465

SEQ ID NO: 113448 - DNA, 201 bp, Bos taurus
ggaggtccaaaacctagcaaaaattccaatagatcttaacgcttcagaataaacctctttgtttcagtgatttgccgcgcagaaccatggggctggcagcrtcattcccagggccctaaggaagtgaccccacctgcttcagctctttgcagggccacctcctttaaaactaaggagaggagatgtccttggtcttgagcc

SEQ ID NO: 113449 - DNA, 201 bp, Bos taurus
attttatcttttttaagtggaatgcacccatgttcactcatgtttatatcatctatgattaccttcttcacagtaacaataacagttcagtaacagttccytgtatttcagtgaatggttcacagttcacagtgaacaataacagttccctgtaacaatgcactgagttgtcaagacatacctatggcctgtgtgtatgcg

SEQ ID NO: 113450 - DNA, 201 bp, Bos taurus; identical to SEQ ID NO: 32468

SEQ ID NO: 113451 - DNA, 201 bp, Bos taurus; identical to SEQ ID NO: 32469

SEQ ID NO: 113452 - DNA, 201 bp, Bos taurus; identical to SEQ ID NO: 32470

SEQ ID NO: 113453 - DNA, 201 bp, Bos taurus; identical to SEQ ID NO: 32471

SEQ ID NO: 113454 - DNA, 201 bp, Bos taurus
atcaaggtgctgagggtgggtgcttgctgaggcctcgctgccttgctggcagtgcctgctcagtgagggtgtcctcacatggcctttctccgtgctctccrgtgcctgcctcttcttataaggatgcccgtcctcttggattaagtccccaccgtcatgacctcacgcaaccttagttacctcctcagaggccctgtcgcc

SEQ ID NO: 113455 - DNA, 201 bp, Bos taurus; identical to SEQ ID NO: 72236

SEQ ID NO: 113456 - DNA, 201 bp, Bos taurus; identical to SEQ ID NO: 32474

SEQ ID NO: 113457 - DNA, 201 bp, Bos taurus; identical to SEQ ID NO: 32475

SEQ ID NO: 113458 - DNA, 201 bp, Bos taurus; identical to SEQ ID NO: 72239

SEQ ID NO: 113459 - DNA, 201 bp, Bos taurus
taaccccctgagcatcccagcttgtaccatataatgacctagataccaatttttcttcttttttcctttgtggaatgtcatgactcttgaattgataatgrccatgatttaaatgttcttggtttccatgagtatcttgcagtaggatttaaaaaatattttttatagagttattttgaggatgattctgcagttttttat

SEQ ID NO: 113460 - DNA, 201 bp, Bos taurus; identical to SEQ ID NO: 32476

SEQ ID NO: 113461 - DNA, 201 bp, Bos taurus
gaatagaagatgcaactctcttgcatagaagatcctactcagaataggagtagtttgtaagcagtcacggggtttcagccttgcaaagatctcagttccayatagatttctcacaggtaaaggaaagcaatggtgaaatcctatcctaattttattttgtttgataaaaatcctaatttaataaaagttgaacaaactttg

SEQ ID NO: 113462 - DNA, 201 bp, Bos taurus; identical to SEQ ID NO: 72243

SEQ ID NO: 113463 - DNA, 201 bp, Bos taurus; identical to SEQ ID NO: 72244

SEQ ID NO: 113464 - DNA, 201 bp, Bos taurus; identical to SEQ ID NO: 72245

SEQ ID NO: 113465 - DNA, 201 bp, Bos taurus; identical to SEQ ID NO: 72246

SEQ ID NO: 113466 - DNA, 201 bp, Bos taurus
aaagtgtagaaggggtccagagtggatgcagagaaaccattaggaggttacagtagttgtccaagcaagaaatgctgttgctttgggcctagggaagtgtycatggagatggggagaggggatgccctgagtatggtaggatagggagagagaggttaaggatagtgcataagttttctggtacaggccactgagtgaaag

SEQ ID NO: 113467 - DNA, 201 bp, Bos taurus; identical to SEQ ID NO: 72247

SEQ ID NO: 113468 - DNA, 201 bp, Bos taurus; identical to SEQ ID NO: 72248

SEQ ID NO: 113469 - DNA, 201 bp, Bos taurus; identical to SEQ ID NO: 72249

SEQ ID NO: 113470 - DNA, 201 bp, Bos taurus
gttgtgggcaagtttggagctctaagagaccttatttgtttgggaggattttggaaggcttcttggagatggtggacttagaacaaggtaacaaaataagrgcaagtccttgtcagaggcagaagaacagaaagagataggagggtatctcatgcaggggaaatggtaagaaccaaagaaagactttgtggggtagtgtct

SEQ ID NO: 113471 - DNA, 201 bp, Bos taurus; identical to SEQ ID NO: 32480

SEQ ID NO: 113472 - DNA, 201 bp, Bos taurus; identical to SEQ ID NO: 32481

SEQ ID NO: 113473 - DNA, 201 bp, Bos taurus; identical to SEQ ID NO: 32482

SEQ ID NO: 113474 - DNA, 201 bp, Bos taurus; identical to SEQ ID NO: 32483

SEQ ID NO: 113475 - DNA, 201 bp, Bos taurus; identical to SEQ ID NO: 32484

SEQ ID NO: 113476 - DNA, 201 bp, Bos taurus; identical to SEQ ID NO: 32485

SEQ ID NO: 113477 - DNA, 201 bp, Bos taurus
acgctgagaaggggatttaataggagtggggatgctttcttcattttaacaggaaaggaggcagatccaggtagaaataatgaagcaaaaaattaaggtayttgtttgttagtgtctgtctattctataaaaatttttaagttcgggcttccctggtggtccagcaattgtgactctgcacttccactgcagggggcatgg

SEQ ID NO: 113478 - DNA, 201 bp, Bos taurus
gtttttcatgattacttttactgtagagatgtcttttcattcactgcatgtaaactgagaaagcttttctctatcacaagatccttgagatccttaaagcrttatctatcagttctgtttatatatttaatacttaacagataaattatctgcacattggtttattttatgatgtgtagtaaaaaaatcaaagaaaatttt

SEQ ID NO: 113479 - DNA, 201 bp, Bos taurus; identical to SEQ ID NO: 32486

SEQ ID NO: 113480 - DNA, 201 bp, Bos taurus
tggagcatctgtatagcttccagggtgttgcttgatctatcttagttctcagaggaaacgaaggcagcatacgctcaaggccagttgaccgttgcaagttrtataacaacatttctattgcacctatcttcccataattcagtctgttataatcagatgtgtatatgtatacaatatttatgaacacttaaagtgctgcga

SEQ ID NO: 113481 - DNA, 201 bp, Bos taurus; identical to SEQ ID NO: 32487

SEQ ID NO: 113482 - DNA, 201 bp, Bos taurus
aaaaatagaagtctgaatgatatttggtctggttccatgaagattgattgagacctcaaattgtctgggtttattaatataataaaatgtattcccagagrtttaagtagattcactccttcagtcaaacagaaactaccttttaaaaaagaaaacataatttaaaagcaatatatttatccaagtctccactgctgcata

SEQ ID NO: 113483 - DNA, 201 bp, Bos taurus; identical to SEQ ID NO: 32490

SEQ ID NO: 113484 - DNA, 201 bp, Bos taurus; identical to SEQ ID NO: 32491

SEQ ID NO: 113485 - DNA, 201 bp, Bos taurus; identical to SEQ ID NO: 32492

SEQ ID NO: 113486 - DNA, 201 bp, Bos taurus; identical to SEQ ID NO: 32493

SEQ ID NO: 113487 - DNA, 201 bp, Bos taurus; identical to SEQ ID NO: 32494

SEQ ID NO: 113488 - DNA, 201 bp, Bos taurus; identical to SEQ ID NO: 72265

SEQ ID NO: 113489 - DNA, 201 bp, Bos taurus; identical to SEQ ID NO: 72267

SEQ ID NO: 113490 - DNA, 201 bp, Bos taurus; identical to SEQ ID NO: 32496

SEQ ID NO: 113491 - DNA, 201 bp, Bos taurus; identical to SEQ ID NO: 32497

SEQ ID NO: 113492 - DNA, 201 bp, Bos taurus; identical to SEQ ID NO: 32498

SEQ ID NO: 113493 - DNA, 201 bp, Bos taurus
gtgtctgagtcaggatagtggagaacagagctgccaagctggcttgtgataaaactcacttgcatttatcataacagaaaatttgttgaggtttccttaamtagctctcagctgtctaggtgctgcttttttggtggattagcttccgcaagacagggtgcttcaaaagacagaagagctagaaatagtctatggtatagc

SEQ ID NO: 113494 - DNA, 201 bp, Bos taurus; identical to SEQ ID NO: 32499

SEQ ID NO: 113495 - DNA, 201 bp, Bos taurus; identical to SEQ ID NO: 32500

SEQ ID NO: 113496 - DNA, 201 bp, Bos taurus
atgacatttcattcctttgccagcctatgaaggaaaagtgggaggttaaaaaaaaaaaaagggaggtcaatatgaatttactccaagtcaactgtaatctrtatcctgtcttcctaatacatctcataacaaaagcttgttgtatcagtatattccaaacgtttgtaagttatttagaacttggaacatgttttcccatag

SEQ ID NO: 113497 - DNA, 201 bp, Bos taurus
tgactctcttgaatcctctcacaggctctacgttttcttaaatgtactaatcctactgtggatttctctatccccagaaagcataagtacccatcttgctyatttacatttgtaaggttttgttctttctggatatctttgtatttgcatgctttttctttctccttctctctttttgaccattgcacttgtctttaaaaa

SEQ ID NO: 113498 - DNA, 201 bp, Bos taurus
tttttatacagatatataaatgaccatgaatgaccctattcagttgctccaaggactccaaatctactgggagaaacaagcaatgaatagcagttataatrccatatagtaagtgcttctctggagtacacataggagatgcaaagcccattccaggaacggtatggagtggttggctggagccatctgaggcaggaaggt

SEQ ID NO: 113499 - DNA, 201 bp, Bos taurus; identical to SEQ ID NO: 32504

SEQ ID NO: 113500 - DNA, 201 bp, Bos taurus; identical to SEQ ID NO: 32507

SEQ ID NO: 113501 - DNA, 201 bp, Bos taurus
ggggcggggaacagaaaggggccaatcattctaacttcaggaacctggtagctagagataccaatgaataaatgatggtgatcataccagtacatttggcrggtggtttgatctacatcctggcctgagtgttcaaagagcagtgggcaactggccagcttaggggacagctaatccttaactcatggtccaggtgtcatc

SEQ ID NO: 113502 - DNA, 201 bp, Bos taurus; identical to SEQ ID NO: 32511

SEQ ID NO: 113503 - DNA, 201 bp, Bos taurus; identical to SEQ ID NO: 72283

SEQ ID NO: 113504 - DNA, 201 bp, Bos taurus; identical to SEQ ID NO: 32513

SEQ ID NO: 113505 - DNA, 201 bp, Bos taurus; identical to SEQ ID NO: 32516

SEQ ID NO: 113506 - DNA, 201 bp, Bos taurus; identical to SEQ ID NO: 32517

SEQ ID NO: 113507 - DNA, 201 bp, Bos taurus
ggtcaggcagctagcccaagttagggagcaggagtgttggaatttaaacctagaaaatattgtcccagtaatgttaaactaatcatgaacatcacttttcraactgcagctaacccttagattctcacattctttaacagcactatattctctgtacaatagcttcaaagcttcagcaaattagattccaagatgctgtgc

SEQ ID NO: 113508 - DNA, 201 bp, Bos taurus
cacaactactgaagcctgcacagcctagagcccatgttctgcaacaagaggagccactgcaatgacaagccagagcaccgcaactagagagtagcctccaytcgctgtaagcagataaaagcccactcagcaaagaagatgcagcatagccacaagtaaaaaaccaatctttttttaaaagtgactgtaacagaaaccagc

SEQ ID NO: 113509 - DNA, 201 bp, Bos taurus
tttcggtttgcagtccctccacccactacctagattctctttttctgagatatgtttagatgttggagagaatcacatgattttctccagaaatcatcctyggccaaatcgagttattttaaatcatttacccacagcagatattgcagaaactctcagagcatgtgcagcctgcactgaccagatctctccaccctttac

SEQ ID NO: 113510 - DNA, 201 bp, Bos taurus
tacaagctaaaaggtttccaaaaacctgcacggtaatacatgtgtgaggagtcatctctaacagataaaacagtgaaactcatcaaaaagcaacttccgtrtattcaaaaatattattggcaacaataatactccctcaaacctacattactgtatttttcattcagttatgttatttcacatctttgtgactcactgatc

SEQ ID NO: 113511 - DNA, 201 bp, Bos taurus; identical to SEQ ID NO: 32519

SEQ ID NO: 113512 - DNA, 201 bp, Bos taurus; identical to SEQ ID NO: 32520

SEQ ID NO: 113513 - DNA, 201 bp, Bos taurus; identical to SEQ ID NO: 72287

SEQ ID NO: 113514 - DNA, 201 bp, Bos taurus
ctttttcatccttggagaaagtttctacactattaatgggaatctaaattgatcttctaaccttcctagatgtctaggaacaagctttttgtagaaggatrgtgattatagaacctttctcaattttgctagtcagacaccttgaagaaatcaattagtaggcaaattattaactaattgagcatttagagtgttcttact

SEQ ID NO: 113515 - DNA, 201 bp, Bos taurus; identical to SEQ ID NO: 32523

SEQ ID NO: 113516 - DNA, 201 bp, Bos taurus; identical to SEQ ID NO: 32525

SEQ ID NO: 113517 - DNA, 201 bp, Bos taurus; identical to SEQ ID NO: 32528

SEQ ID NO: 113518 - DNA, 201 bp, Bos taurus; identical to SEQ ID NO: 32531

SEQ ID NO: 113519 - DNA, 201 bp, Bos taurus; identical to SEQ ID NO: 32532

SEQ ID NO: 113520 - DNA, 201 bp, Bos taurus; identical to SEQ ID NO: 32533

SEQ ID NO: 113521 - DNA, 201 bp, Bos taurus; identical to SEQ ID NO: 32534

SEQ ID NO: 113522 - DNA, 201 bp, Bos taurus
aacacacagttgatacgatagtgactattcacttatgcctgcatatagatgtaatttaacatactaacatgtgatttggttttacaatgggtatgaaatamtgttacccagagagagaagatttagaagggtggatggatctgaaatttagggttttgtaaataggaataaggtccatggaaacaagagcttaaagtaaca

SEQ ID NO: 113523 - DNA, 201 bp, Bos taurus
atttgattcaggcataaaatctgtaatcctttcatttcaatttggacaaaccaaaccttcattctgccccaaaccctcaacttgtatatgaagaatgctgmaattattcctctcctcttttcctcttacaccacagctgtcttctttccatctccccaatcccagtcttccccaacctcagatatggggacctcggggcaa

SEQ ID NO: 113524 - DNA, 201 bp, Bos taurus
tatagagttttaaaaatagattttgccacacaatcatgcccacaaatgctgacttgcagtctgggaactatctcttcgtcaggcccagcaagatgaaagcmggttctattttcatcgtgagagagctgcagggtggaggcacaaaggcgaaattcacttttcatgtccatcaggcagagcccctcaccaaccaaagcgggg

SEQ ID NO: 113525 - DNA, 201 bp, Bos taurus; identical to SEQ ID NO: 32536

SEQ ID NO: 113526 - DNA, 201 bp, Bos taurus; identical to SEQ ID NO: 32537

SEQ ID NO: 113527 - DNA, 201 bp, Bos taurus
aagggaatcgctaatgggactggacagaatccaaaagcagatattaggataatagtgagtccctgacctaggttacggtgttaattctggagggcagactygtggtacattttcaatagctttgtggggctgctgtcacggtcacatatgcctcaactatatatggttcctagcccccccctccccacgacatactttttt

SEQ ID NO: 113528 - DNA, 201 bp, Bos taurus; identical to SEQ ID NO: 72303

SEQ ID NO: 113529 - DNA, 201 bp, Bos taurus; identical to SEQ ID NO: 32540

SEQ ID NO: 113530 - DNA, 201 bp, Bos taurus; identical to SEQ ID NO: 32541

SEQ ID NO: 113531 - DNA, 201 bp, Bos taurus
tgtgtggtattttaacctcctaccagggatcgaacccacaccccttgcactggaaggcaaaatcttaaccactggaccgccaaggaagtctcatagatctrgttcttaataggagactccttctccctctttgatgctgctgactgaaaaggggaggaggaacaggaggaagaaagaagagaagaaaaaggggaagaaacg

SEQ ID NO: 113532 - DNA, 201 bp, Bos taurus; identical to SEQ ID NO: 32542

SEQ ID NO: 113533 - DNA, 201 bp, Bos taurus; identical to SEQ ID NO: 32543

SEQ ID NO: 113534 - DNA, 201 bp, Bos taurus; identical to SEQ ID NO: 72313

SEQ ID NO: 113535 - DNA, 201 bp, Bos taurus; identical to SEQ ID NO: 72314

SEQ ID NO: 113536 - DNA, 201 bp, Bos taurus
tggcataccagtcattaggaggcaaactggggattgctaagtgagagaatgatttccaaatgcattgaagtttttgggtccacaaattctgcctaagctakgaacagctcatcatttcctcaaagcatattacagagtaggtcctcctaagtgggtccactagcctgccctagacttcccagatggttcagcgggtaaaaa

SEQ ID NO: 113537 - DNA, 201 bp, Bos taurus
aagaaaaagaaacaggagcattagaacaagacagagcatctgtaaggtggcacaatctggagcccccatgtgaggcatcctgaggtctgggcagtgaatayccctcacccaatttgcggagatggcaatggaaccagcctggggtcaagtggttgatttttctacatccacagctcaggaaagttttaatgtatctttgca

SEQ ID NO: 113538 - DNA, 201 bp, Bos taurus
cagactgctcttactagatgaccaactaaaatagctggaagacaatactttagaaatggatagttgtaagattataaaaatgcaaaaaatccctttttttkgtcttctccccaacactgagtgtcttcgcaaatgtcacccactcagaaaacatttcctctccatttaagatttggttgcattccgggttgtgtgctccct

SEQ ID NO: 113539 - DNA, 201 bp, Bos taurus; identical to SEQ ID NO: 32552

SEQ ID NO: 113540 - DNA, 201 bp, Bos taurus; identical to SEQ ID NO: 32553

SEQ ID NO: 113541 - DNA, 201 bp, Bos taurus; identical to SEQ ID NO: 32555

SEQ ID NO: 113542 - DNA, 201 bp, Bos taurus; identical to SEQ ID NO: 32556

SEQ ID NO: 113543 - DNA, 201 bp, Bos taurus; identical to SEQ ID NO: 32557

SEQ ID NO: 113544 - DNA, 201 bp, Bos taurus
gcatgcagacacttccctctggcggatactgacattctggagtaaggcaaaggggaaaatgtaaagatggtacctgccacaaaaggaaaaatgaaagctamaaaataaggctttgccagggaaatgtgtctagagttaaataaataaataaataattttaaaaacttaaagtaaaaaatatggtgcccaccagactctgtt

SEQ ID NO: 113545 - DNA, 201 bp, Bos taurus; identical to SEQ ID NO: 72328

SEQ ID NO: 113546 - DNA, 201 bp, Bos taurus; identical to SEQ ID NO: 32559

SEQ ID NO: 113547 - DNA, 201 bp, Bos taurus; identical to SEQ ID NO: 32560

SEQ ID NO: 113548 - DNA, 201 bp, Bos taurus; identical to SEQ ID NO: 32561

SEQ ID NO: 113549 - DNA, 201 bp, Bos taurus
ggaatctcagaaatgactcttcaaaacaatagaatcttaaagcaagtattgggaagtcaggctctgctacagattaaaaactggaattgacatgctgtgtytccatatcaactctttaatatcatttaatgatcagtttaattcctactgtttggttaagtttggcatcattcctgcttttgctaatatttcctttggtgc

SEQ ID NO: 113550 - DNA, 201 bp, Bos taurus; identical to SEQ ID NO: 32563

SEQ ID NO: 113551 - DNA, 201 bp, Bos taurus; identical to SEQ ID NO: 32564

SEQ ID NO: 113552 - DNA, 201 bp, Bos taurus
gtatcaggaatcttaagtaaatttaatttaaaatgtaataagaagacacttgtgttgtttaataacaaaataattcattaacagggcctgctttttcaatwtgtgtataaaactctttataacttgacttttaaggtaaatgacaacacgtattttacaaattggaagaatttaagtatacccagggaattctgagtatgt

SEQ ID NO: 113553 - DNA, 201 bp, Bos taurus; identical to SEQ ID NO: 32565

SEQ ID NO: 113554 - DNA, 201 bp, Bos taurus; identical to SEQ ID NO: 32566

SEQ ID NO: 113555 - DNA, 201 bp, Bos taurus; identical to SEQ ID NO: 32567

SEQ ID NO: 113556 - DNA, 201 bp, Bos taurus
agagtaatggagtggcgtggcattgccttccccggtgtacccaactatatatccttaaaaatatgtgacacaagtaaagactcaaatatttgttgaatatrtgcaaacaaagaaaatcttcacacctacttggagagtaatagtgaagattagcagaaatcaagggtgagaaataaagtaacatactgcatggtaattggg

SEQ ID NO: 113557 - DNA, 201 bp, Bos taurus; identical to SEQ ID NO: 32568

SEQ ID NO: 113558 - DNA, 201 bp, Bos taurus
tccaacctggggatcttgcaaagggactgagaacctccagggaatttgactttggaggccagtaggattttattacaaatcttccacaggactggggaaayagactctatcaggacacaagcaaaatcttgtgtcctgtacaaacaggacctaggagaaaggagcagtgattcccaaaacagatagagccaaacttgcttg

SEQ ID NO: 113559 - DNA, 201 bp, Bos taurus; identical to SEQ ID NO: 32570

SEQ ID NO: 113560 - DNA, 201 bp, Bos taurus; identical to SEQ ID NO: 32571

SEQ ID NO: 113561 - DNA, 201 bp, Bos taurus; identical to SEQ ID NO: 32572

SEQ ID NO: 113562 - DNA, 201 bp, Bos taurus
gtcatgtgttacttatttatactctatgaggtatatgttatataaaaagtgctatttagtagattagaagatatgtaaatgtacctaaaatgtgactcctrtgtttgatatattcaaagactgacaatcacactaatttacatcagacaaaaaatatacctaccacggtagagcaaaagtgttttctaccatccttagaaa

SEQ ID NO: 113563 - DNA, 201 bp, Bos taurus; identical to SEQ ID NO: 32576

SEQ ID NO: 113564 - DNA, 201 bp, Bos taurus; identical to SEQ ID NO: 32577

SEQ ID NO: 113565 - DNA, 201 bp, Bos taurus; identical to SEQ ID NO: 32578

SEQ ID NO: 113566 - DNA, 201 bp, Bos taurus; identical to SEQ ID NO: 72340

SEQ ID NO: 113567 - DNA, 201 bp, Bos taurus; identical to SEQ ID NO: 32579

SEQ ID NO: 113568 - DNA, 201 bp, Bos taurus; identical to SEQ ID NO: 32582

SEQ ID NO: 113569 - DNA, 201 bp, Bos taurus; identical to SEQ ID NO: 32583

SEQ ID NO: 113570 - DNA, 201 bp, Bos taurus; identical to SEQ ID NO: 32584

SEQ ID NO: 113571 - DNA, 201 bp, Bos taurus; identical to SEQ ID NO: 32585

SEQ ID NO: 113572 - DNA, 201 bp, Bos taurus; identical to SEQ ID NO: 32586

SEQ ID NO: 113573 - DNA, 201 bp, Bos taurus; identical to SEQ ID NO: 32587

SEQ ID NO: 113574 - DNA, 201 bp, Bos taurus; identical to SEQ ID NO: 32588

SEQ ID NO: 113575 - DNA, 201 bp, Bos taurus; identical to SEQ ID NO: 32589

SEQ ID NO: 113576 - DNA, 201 bp, Bos taurus; identical to SEQ ID NO: 32591

SEQ ID NO: 113577 - DNA, 201 bp, Bos taurus; identical to SEQ ID NO: 32592

SEQ ID NO: 113578 - DNA, 201 bp, Bos taurus; identical to SEQ ID NO: 32593

SEQ ID NO: 113579 - DNA, 201 bp, Bos taurus; identical to SEQ ID NO: 32595

SEQ ID NO: 113580 - DNA, 201 bp, Bos taurus; identical to SEQ ID NO: 32597

SEQ ID NO: 113581 - DNA, 201 bp, Bos taurus; identical to SEQ ID NO: 32598

SEQ ID NO: 113582 - DNA, 201 bp, Bos taurus; identical to SEQ ID NO: 32599

SEQ ID NO: 113583 - DNA, 201 bp, Bos taurus; identical to SEQ ID NO: 32600

SEQ ID NO: 113584 - DNA, 201 bp, Bos taurus; identical to SEQ ID NO: 72347

SEQ ID NO: 113585 - DNA, 201 bp, Bos taurus; identical to SEQ ID NO: 32601

SEQ ID NO: 113586 - DNA, 201 bp, Bos taurus; identical to SEQ ID NO: 72348

SEQ ID NO: 113587 - DNA, 201 bp, Bos taurus; identical to SEQ ID NO: 72349

SEQ ID NO: 113588 - DNA, 201 bp, Bos taurus; identical to SEQ ID NO: 32604

SEQ ID NO: 113589 - DNA, 201 bp, Bos taurus; identical to SEQ ID NO: 32605

SEQ ID NO: 113590 - DNA, 201 bp, Bos taurus; identical to SEQ ID NO: 32606

SEQ ID NO: 113591 - DNA, 201 bp, Bos taurus; identical to SEQ ID NO: 32607

SEQ ID NO: 113592 - DNA, 201 bp, Bos taurus
catggcccatccagcgaagcacagccatggttcctgaccttggacatggagtatctctccacagctgctctagcgaagtgcaggagcctctcctgaccttkgacattgggtatctcctcaaggccgctagagagtgaaaaaattggcttaatgctcaacattcagaaaacaaagattatggcatctggtcccatcacttca

SEQ ID NO: 113593 - DNA, 201 bp, Bos taurus; identical to SEQ ID NO: 32610

SEQ ID NO: 113594 - DNA, 201 bp, Bos taurus; identical to SEQ ID NO: 32611

SEQ ID NO: 113595 - DNA, 201 bp, Bos taurus
caactaagaaatgtgcatcagactctgaatctgtgactcagttatcttaatcattaaccacttggttctgtactgggcccttcagggttccgctggattcyattatgtttgacaggtaaagacatgctattttcagaacaaggaaaaataagtatagggccattgaatcctagaatgacccttgaggcccaggtaaacaat

SEQ ID NO: 113596 - DNA, 201 bp, Bos taurus; identical to SEQ ID NO: 32613

SEQ ID NO: 113597 - DNA, 201 bp, Bos taurus
gctcctgtggcctgtggcagtcaagagtacacagcagccagcagcctccttagcatcctcttggatgacgttcagtgagtttcagcccatgaatagctttycctggccacgtagaggatgcatttccagcaaatgtggccaaccagcaccatgctggcttttgtggcacctagtgagtcaaacttgtgctctcgccaacac

SEQ ID NO: 113598 - DNA, 201 bp, Bos taurus
cacagaatccctctttgaatgtatgtttggcaggccccatgaattcacgtttgagattatgccctctactgggttttagtgaatcctctcataatcacaakcatattcaatacttaaaagggcctctttcttccctagaaattttgagacttaaagccataaggatccagaaggacttgtccctatggaaagggttatttc

SEQ ID NO: 113599 - DNA, 201 bp, Bos taurus
aatccatgtacaatgtaactttttaatattgatataaggcctacctaaaattttatacaacttgcatcgtggatttttcaggcaaagaggagactttagcrgtgaccaggcctgatgaggaataaagtggatttggaaagacagagtcaagccaagacaagatgcaggcctcctgcatctcccttttctgagcaggcaaaa

SEQ ID NO: 113600 - DNA, 201 bp, Bos taurus
gtcatccaaaaaggcaaaactgtcttaagtggataaagtgatgtttatatgcagttaaaacaagcaatcactcagggtttgaacagttttaaaagtcaaakcacagcatagatgaacagtgaatatgtggtcctgatggggcatcacttggacatcttagtctctgaaagtgtctccccagtgtctagggtcttcaacaac

SEQ ID NO: 113601 - DNA, 201 bp, Bos taurus; identical to SEQ ID NO: 32615

SEQ ID NO: 113602 - DNA, 201 bp, Bos taurus; identical to SEQ ID NO: 32616

SEQ ID NO: 113603 - DNA, 201 bp, Bos taurus; identical to SEQ ID NO: 32617

SEQ ID NO: 113604 - DNA, 201 bp, Bos taurus
agaaagagcaattgaaagggtatcactcagaaatggatgtcatacttaataagacttttgttccttgcttttatgaaaggatgagtatgttgtttctattrggatatccatgttgtgttaaaggggggaatttgggtgtttgtttgtttgttttatattgctgtttggaagtttaagtaagggaagaaaggcatgtgagtg

SEQ ID NO: 113605 - DNA, 201 bp, Bos taurus; identical to SEQ ID NO: 32633

SEQ ID NO: 113606 - DNA, 201 bp, Bos taurus; identical to SEQ ID NO: 72381

SEQ ID NO: 113607 - DNA, 201 bp, Bos taurus
agatgtaaaattaatattaaatcatgcatgtttatttttcctttgctctatggagtccttaactaggaggtgttttccagttattaaacacaagggctccrtctagtggccaaactgtatatagtgtttttcaacctatgggtcttagggaaaacaatgtttctgatggaataaaattgaatataaagtaccagagtgatg

SEQ ID NO: 113608 - DNA, 201 bp, Bos taurus; identical to SEQ ID NO: 32638

SEQ ID NO: 113609 - DNA, 201 bp, Bos taurus; identical to SEQ ID NO: 32639

SEQ ID NO: 113610 - DNA, 201 bp, Bos taurus; identical to SEQ ID NO: 32640

SEQ ID NO: 113611 - DNA, 201 bp, Bos taurus; identical to SEQ ID NO: 32641

SEQ ID NO: 113612 - DNA, 201 bp, Bos taurus; identical to SEQ ID NO: 32642

SEQ ID NO: 113613 - DNA, 201 bp, Bos taurus
cgcctctctttgttccttggctacatcatcttgccctgacctcagcttgggatgctcttctgtcatccttccttggccagatctttcttattatttaggtyttggcttaaagtatatctcctctaagaaacctgatttgaccacttaatctaaagaggccatttagactaacttgctgttcgttcccttcatcctatttta

SEQ ID NO: 113614 - DNA, 201 bp, Bos taurus
tcatttaagcccttaggccagttataaggaaatctatttcaaacttgctattacagataattaatactttatgctgaatcactctgtatcagaattcatartctgtgaccatacagccctttgctttacatgccatctccattactttttaaaatttttttattgaagaacaattagtatacaatattatataagttacaa

SEQ ID NO: 113615 - DNA, 201 bp, Bos taurus; identical to SEQ ID NO: 72389

SEQ ID NO: 113616 - DNA, 201 bp, Bos taurus
cagtaaaaatgcctaattttattactgtagttttgacccataaaatataaacttataacactaaccactggaccaccagggaaaaaaatcacaatgaacayaactctgtggaccccaagtacacttagctgagtttttcaatgtagcttggtaatacttttacttgtcctctcattctgagattactgctccaacctacac

SEQ ID NO: 113617 - DNA, 201 bp, Bos taurus
ctgggactggaaagccagggatggagactgactgctaactggcccagaatttctttttgagatgatggaatgttctggaattagatcatgatgatggttgyacaacattgtaatgtactaaaacacactgaattgtacattttaaaatcgtgaattttatttcagtagaaaaaattatgagaataaaagagttaaataact

SEQ ID NO: 113618 - DNA, 201 bp, Bos taurus
ataatcaggccttgaactcaggaaggttggtacaaaggattgtactcttaactattacattattgtcatgtaattttgaaagaatgataaatcataactayaggaagatactgtttacattttggagtggtaaatagtctaatcaatcttggaaattaaaaacttgggccctgccaaagtcaccataaataaaactaaaag

SEQ ID NO: 113619 - DNA, 201 bp, Bos taurus; identical to SEQ ID NO: 32649

SEQ ID NO: 113620 - DNA, 201 bp, Bos taurus
tcactccaaaacaggagagggttacaaatgtgacaaggccctctaggaagctgaggattgaaaagtgtcaattggattaggagtgagggccactgttgagyttgacagtaggtgctaattaactgctcacattatcacttcctgagtttagctctttgtgtgaaccagcaggctgccatgcacatggcgtctctcaggccc

SEQ ID NO: 113621 - DNA, 201 bp, Bos taurus; identical to SEQ ID NO: 72393

SEQ ID NO: 113622 - DNA, 201 bp, Bos taurus; identical to SEQ ID NO: 32652

SEQ ID NO: 113623 - DNA, 201 bp, Bos taurus; identical to SEQ ID NO: 32653

SEQ ID NO: 113624 - DNA, 201 bp, Bos taurus
caccctgaattaaatccaggttctaacagtgaaaatggagcaggatacaggtactgagtgagtgagcaattaattgcatctccattttgagtctccatccmagaaacaagaaagtcattcatggactagaaaaggtaattaattacaatatttccaaagtgtcttctgctccccacaccaaaagcgtctactacatataaa

SEQ ID NO: 113625 - DNA, 201 bp, Bos taurus
catgaatatgaaaatgcaaaccaaggcatgcaaagatttatactcaacggtagaaacatcaatattgctgaaaagctacatccatcagctcagcctgctgyagcatatttagtcccaagactgagaaggctgaaccctaggcaatttatctgcatgtgtgtcgggctaaccacacaaattttgcagatgaagctagaagtt

SEQ ID NO: 113626 - DNA, 201 bp, Bos taurus
cctgtcctgggtacaccagtggtcttccaagtgtgggccccagaccagcagaatcagcatctcctgggaagctgttagaagtacagactttcatcaggctrcaccacaggcctgcgggatcagaagccctgccgtggggccggccctgtgtgctgtaacatgcccgcaggctactgacgcgcactgaggtgcacgatgatt

SEQ ID NO: 113627 - DNA, 201 bp, Bos taurus
tgtaagggcaatacctcctggagttgtacaactcagagcttctgtttcttcagtgagattatgcccagttggcttattccttaaaatgttactaatctttrgcaatgaaggtgactttggtcttttttttaaattgaagtatatagttgctgtataatattatgtaagttaagggtgtataatatgctggacaagggaatg

SEQ ID NO: 113628 - DNA, 201 bp, Bos taurus
gattatctaggctagccttttctcattctgaagagtgatgaagaattggcttccagaaagcgcaaaaaatgaaacagttttacttcttagacacaaattcktattgatgataataattaagtaaatactcatgcatgttgtattttttttaattaagcaaacctttcattttcttattataaagatatggaaatacaacaa

SEQ ID NO: 113629 - DNA, 201 bp, Bos taurus; identical to SEQ ID NO: 32654

SEQ ID NO: 113630 - DNA, 201 bp, Bos taurus; identical to SEQ ID NO: 32655

SEQ ID NO: 113631 - DNA, 201 bp, Bos taurus
gagaaatggatactcttcaaaaattgcactgacattgactaactaaactcctaccaggaatttgatcaacaagagactgaagccatagcaggctgggaaaygtacccaacaattctgtccttgatgcctcctaattatacagtgaagaaacagaaggatgtcacaagagcatgcacttcaataaacatttgcttgaaatgg

SEQ ID NO: 113632 - DNA, 201 bp, Bos taurus; identical to SEQ ID NO: 32658

SEQ ID NO: 113633 - DNA, 201 bp, Bos taurus; identical to SEQ ID NO: 32659

SEQ ID NO: 113634 - DNA, 201 bp, Bos taurus; identical to SEQ ID NO: 32660

SEQ ID NO: 113635 - DNA, 201 bp, Bos taurus; identical to SEQ ID NO: 32664

SEQ ID NO: 113636 - DNA, 201 bp, Bos taurus; identical to SEQ ID NO: 32665

SEQ ID NO: 113637 - DNA, 201 bp, Bos taurus; identical to SEQ ID NO: 32666

SEQ ID NO: 113638 - DNA, 201 bp, Bos taurus; identical to SEQ ID NO: 32668

SEQ ID NO: 113639 - DNA, 201 bp, Bos taurus
agcttccctttctgttagatgtgtttgtgtggctgtcttctggtcagtgaagtgtgagctggcacggtgtatacctgatgcagtccaggccctttgaaatytcctgttctccatccaccagtttaaaacaggggaatccaggggcttggatagaaagaccctgggcctctgctgtatgcatctgtcatcctaaactggact

SEQ ID NO: 113640 - DNA, 201 bp, Bos taurus
gaaactctctttcccagtccttcctcatcatatcatttagccatcaaccatcaactgaaaatacaagaactgcatggcatctactttctcacagaagtgtytgtcttcctggagaaggagaagtgagactctggtgtctgtcctgcttcagtgtgggaaactgcaacatctgcccctagacacaggagttgggtccccccg

SEQ ID NO: 113641 - DNA, 201 bp, Bos taurus
atttaatcttcttcttaacaataattatctgtcaatatcttacacttgtatttgtttttacgtccattaactatatctcactctatattataaatgtcttktgagaattcttacttcttttttctattctagcaacaaagaaagagtctagcacattaaaggcaatcaagatttaatcactttcggattgcagaatatcta

SEQ ID NO: 113642 - DNA, 201 bp, Bos taurus
gtctactgatttttagtgaaccacattgaacttatttcataaacttgtcacacagctatttaacttatttaacatgaaagaagaaacatttaatatatctycttaattaacatgaagaaactatcaagatggtaaaccttattcaaatattatttgttgaaatgagtaattcataagcaataaaaataaacatgagaataa

SEQ ID NO: 113643 - DNA, 201 bp, Bos taurus
agaaccctgagaaaaagttgaaatctgggaatgtggcattactaatagaggcatgtggacattgcctactttggtcagaacagaaggattcctaccacttkagtctctatggaatacagtttaaaaattgggatccttgacagtaaggtaatcttcaagttacatatgctatgtgctgacttcatgtttcttatatatttt

SEQ ID NO: 113644 - DNA, 201 bp, Bos taurus; identical to SEQ ID NO: 32677

SEQ ID NO: 113645 - DNA, 201 bp, Bos taurus
ccagagaggtggccactgtggcccatctcataacaggacctacaagaacctcacttggagtgaccaaggagcatggaaccagagtgaagggagcctatgawgggaggcagtgccaggccatactcattgaggtcccacaggcactggcagcccctctttggaaactgctctgcttctttgcactctgggcctatgatggga

SEQ ID NO: 113646 - DNA, 201 bp, Bos taurus
aagaatattacttttgagttcctcttaaaacaatggaaagccataagtggtgccacagaatgccttactctcaaatgtgtgtgcagtgctctaacttctgmctcttaaatacacaaaagaattctgaaaacttctgaccttaaggttcagaaatggattattttgaattacactttggttttcttgtgtcttaagtcatgt

SEQ ID NO: 113647 - DNA, 201 bp, Bos taurus
agatttaattatgtaaaatacatgaggctttaaataaaaatatcacagtaaaactactgtgagaatgtttttcacattcaaaaggagaaatttcaaaaatyattaccaagtattgatttgatatctagtccatgttcaacaccaggctagaaaaaaagagatgtgctctaatctctcagagaacttatcaacaaatatgag

SEQ ID NO: 113648 - DNA, 201 bp, Bos taurus
attccagtggtttctaaatctatatatgtatataaatatcaggttttcccagcagctcctcttagtttgtcaagagcatatttaacacatacaaaactcakttcaaactctatcccatacaatttgtctgttccacatttttaaatggtgactatccatgcatttgcataggtataaaacctacgagctattcattttcat

SEQ ID NO: 113649 - DNA, 201 bp, Bos taurus
cataaattgtctagtagatagcgtcagcagcagaaaaataaagattaagtcaggatttcatatgtgcccttcaaacctaattactaaaagctgaataaacrtaatgctatgggaaggggcagggaccctaaatacaaaaccttacctaaatattttaatatttttgtggtggtttcagttatgcttttgctatgcaaagta

SEQ ID NO: 113650 - DNA, 201 bp, Bos taurus; identical to SEQ ID NO: 32680

SEQ ID NO: 113651 - DNA, 201 bp, Bos taurus
caacatgtgctaagtgtttggactgaagtacagagaaggctgatagttaggaaagaaaaaaaaaacaaaacatatatgagttttaccaggatactattaakgatagaaattgtgacaaaaattaaaaatacataaaagtatttggcagatatttattataatacatggaacacagggcctagatcagtctaagggaaaata

SEQ ID NO: 113652 - DNA, 201 bp, Bos taurus; identical to SEQ ID NO: 32682

SEQ ID NO: 113653 - DNA, 201 bp, Bos taurus; identical to SEQ ID NO: 32683

SEQ ID NO: 113654 - DNA, 201 bp, Bos taurus; identical to SEQ ID NO: 32684

SEQ ID NO: 113655 - DNA, 201 bp, Bos taurus; identical to SEQ ID NO: 32686

SEQ ID NO: 113656 - DNA, 201 bp, Bos taurus
gatagataagatttaaaaataggaaatgattgtgaaggttgttctcgattagggaaatctgagattgatggtgtatgcaaaattgtgagttgaactccacrgaaaatagtgaggtaaatgcagctgaggtctaattccatcaaaattctgggtctagatcttcttcatttttcttctgtttgccaggcaaactccatggta

SEQ ID NO: 113657 - DNA, 201 bp, Bos taurus; identical to SEQ ID NO: 32688

SEQ ID NO: 113658 - DNA, 201 bp, Bos taurus; identical to SEQ ID NO: 32689

SEQ ID NO: 113659 - DNA, 201 bp, Bos taurus
caggtgctgagatttttaaattgtacagtctcagttttgtatggtgagagtctcctgcagttcatggccttggaacacaaggtcacactccagttgtcatrttagtgtcctgtgtgcccatgtgacttccttagatgactcccattggtagaaacctacagctctcaatgtttttgttcacccagaagatcacttcattcc

SEQ ID NO: 113660 - DNA, 201 bp, Bos taurus; identical to SEQ ID NO: 72430

SEQ ID NO: 113661 - DNA, 201 bp, Bos taurus; identical to SEQ ID NO: 32694

SEQ ID NO: 113662 - DNA, 201 bp, Bos taurus
atattaatttgggggcctttttctccccaaggagaaaggaacaagggaaaaatttattctgagggggtcccttttataaatgcacatttagggttcaaaaytgtgaggccttttgtttgttatggattaagcttccattattttttaaaaatgtctgtcgttggataagctggtaggagcacttgtgtgtcgtcaattatt

SEQ ID NO: 113663 - DNA, 201 bp, Bos taurus; identical to SEQ ID NO: 32697

SEQ ID NO: 113664 - DNA, 201 bp, Bos taurus; identical to SEQ ID NO: 32698

SEQ ID NO: 113665 - DNA, 201 bp, Bos taurus; identical to SEQ ID NO: 32699

SEQ ID NO: 113666 - DNA, 201 bp, Bos taurus
gtaacaacaccacacagaggagagcagagttgtcccagccatctgagttgaggccatcctagacaatcagcaaccagctggccctcccaaacatatcaggraaagcaggcaatatggcagagttgcctacctgacccacagctgatcacagacatgcgcaagctcagtcaggatcagctgagcctggcccagaagagccgc

SEQ ID NO: 113667 - DNA, 201 bp, Bos taurus; identical to SEQ ID NO: 72440

SEQ ID NO: 113668 - DNA, 201 bp, Bos taurus
tccagtggaacaatacatcagggtggcctgccaagcaggtgcaaagttttggaagacattgcaataaaggtatctctggataaatgggcaagtcaataaaygtatgccctagggccaatttgcatttattattattttaattatttatttaaagtttatttttggctgcactgggtcttcattgctgtacccgggctctcc

SEQ ID NO: 113669 - DNA, 201 bp, Bos taurus; identical to SEQ ID NO: 32703

SEQ ID NO: 113670 - DNA, 201 bp, Bos taurus; identical to SEQ ID NO: 72443

SEQ ID NO: 113671 - DNA, 201 bp, Bos taurus; identical to SEQ ID NO: 32721

SEQ ID NO: 113672 - DNA, 201 bp, Bos taurus; identical to SEQ ID NO: 32722

SEQ ID NO: 113673 - DNA, 201 bp, Bos taurus; identical to SEQ ID NO: 32728

SEQ ID NO: 113674 - DNA, 201 bp, Bos taurus
cactgtggagacaaatcccctggcagtggcacttctgagatcacactgtgaagcagcagcaatgaggcgatgatgtagaagcaatatgcgtgagaaaatcrctgcttttaaaaatataacttctttaaggatatcatctattttgttctctatggcttctatgtttagattcatatgtttagtgtaattttctaaataagg

SEQ ID NO: 113675 - DNA, 201 bp, Bos taurus
tgaatgactcaactgaattgacttagaagatgatataaaatatgggggaaaatgaaactagattagtggagtttgctggatgacaagctgatttaaaaaakggtctctgagcatatgagagttgaatgaagatttgaaggagatggccttctagataggaggagaaaggacacagcaagcagagggagcagccagggcaga

SEQ ID NO: 113676 - DNA, 201 bp, Bos taurus; identical to SEQ ID NO: 72480

SEQ ID NO: 113677 - DNA, 201 bp, Bos taurus; identical to SEQ ID NO: 32732

SEQ ID NO: 113678 - DNA, 201 bp, Bos taurus
tgtctggccttttatcaatttctattgattaacgagtccaagaaggctggtaggtaatagctctacatttattgactgctgaacaaaatcacttaacctcrcagagcaagtatccttgtttatgaaatggagataataatagggtttgtttattcataaattggccccaatgcataaggacaaggagaaagcaaagggaga

SEQ ID NO: 113679 - DNA, 201 bp, Bos taurus
acatttcttctctggtctttttttgttttttctccccacttctgacatgacccctccaaaagcaggtactctaaaatatttaatatatgttcttaacttayatgtatctttgtaaaataagtaatgacaatttgcatgtttgtatgtttacaaataatgctaaggccttgcattattttttcctatttgatatgttcagca

SEQ ID NO: 113680 - DNA, 201 bp, Bos taurus; identical to SEQ ID NO: 72483

SEQ ID NO: 113681 - DNA, 201 bp, Bos taurus; identical to SEQ ID NO: 72484

SEQ ID NO: 113682 - DNA, 201 bp, Bos taurus; identical to SEQ ID NO: 72485

SEQ ID NO: 113683 - DNA, 201 bp, Bos taurus; identical to SEQ ID NO: 72486

SEQ ID NO: 113684 - DNA, 201 bp, Bos taurus; identical to SEQ ID NO: 32785

SEQ ID NO: 113685 - DNA, 201 bp, Bos taurus; identical to SEQ ID NO: 32787

SEQ ID NO: 113686 - DNA, 201 bp, Bos taurus
tgtcctgtattttgagttacagcaatcattcagaaaatatctatagagtacttaatacatgccaaatactgtgcttaggtggcactagtggtgaagaagtrgcctgccaatgcaggagatgtaagagatgtgggtttgatccctgggtagggaagatcccctggagaagggcatgacaagcccctccagtattcttgcctg

SEQ ID NO: 113687 - DNA, 201 bp, Bos taurus; identical to SEQ ID NO: 32789

SEQ ID NO: 113688 - DNA, 201 bp, Bos taurus; identical to SEQ ID NO: 32790

SEQ ID NO: 113689 - DNA, 201 bp, Bos taurus; identical to SEQ ID NO: 32792

SEQ ID NO: 113690 - DNA, 201 bp, Bos taurus; identical to SEQ ID NO: 32793

SEQ ID NO: 113691 - DNA, 201 bp, Bos taurus; identical to SEQ ID NO: 32797

SEQ ID NO: 113692 - DNA, 201 bp, Bos taurus
caaaaaatcaaaatacgaaaagccaaagcggtattgtaacagattcattaaagactttaaaaatggtccacatcaaaacaatctaaagagaaataaaacayattcttcacctatgagcatcttgcctttctaatgaacctatctttagagtttaagacaggagccaaatctcaaatttcaggtcattaaaatgcacagtgc

SEQ ID NO: 113693 - DNA, 201 bp, Bos taurus; identical to SEQ ID NO: 32798

SEQ ID NO: 113694 - DNA, 201 bp, Bos taurus
tcctatctgcccatcactgttcacaactccatggaaaagctgtcagtctgctaaattggacccacttcttacaaactgattattgacctttccattgtgaygaacccagcttatctgtctctgcaagaaagaaggagctgttgagtcacaactgcaattatgagtcagaacattccagccccagggggagagacaagagaa

SEQ ID NO: 113695 - DNA, 201 bp, Bos taurus
actgctgctcttctcctggaaaatatgaacacaaagaccccatctgaaatctagagcacccctctaaactggagcaggtgtgttaaaaatatcaccacaayactgagtcttagtatgggatgacagtctcaggagctggaatttggggtgggaactgacttctttgaaacaatgatttctggattctcattttgagctctc

SEQ ID NO: 113696 - DNA, 201 bp, Bos taurus
acaaagacactggagaagcctgcagtgtaccttcaggtttgtttcctgacagcagagggtgccacaatgtttctggtgataggaatgttttgtgctgaatratttttcttctacctggtacttaaaataagagctttctcaggatactgacattgaggccttttattatctattatataatagtgacacaaaccaacatca

SEQ ID NO: 113697 - DNA, 201 bp, Bos taurus
cagaaaaaatggtcttaaagtcatcactcggtttcctttgccacattaattcaatgaagcaataatgacagagaatcagaaacgcgctgatgtgtatcaayagaagattaaataattatggtacagacaaaaaaatatcaacagctaacaaagatacattagatgaaaaaaaaaggcctagctttgaatcagctacttcca

SEQ ID NO: 113698 - DNA, 201 bp, Bos taurus
aagcagctaaaagggtgaaatcccaggagatatcaggattacagccctgtcctagatcagacttggccccggggacatagctgagaaaacactagacaccractctcatgaccttgattcatggaaaaagccaaatctgcttacagtcaaggaagccactttgcaccttagttctggcaatgtttctcagggactatcaag

SEQ ID NO: 113699 - DNA, 201 bp, Bos taurus
tctgtattgtaactcttttgatcaataatggcagcaaaatgttacctgaaaaggagcaaggtagcattaaaatccgtgggatttaaacttgtaattccttkgtaggtaagagtgtcaactaggataacagcctttgactagtaaattcatgcatttttctttaaattactaagtggcctcattggtcagtttctgagagag

SEQ ID NO: 113700 - DNA, 201 bp, Bos taurus
accttcagctagaccccaaaggacatacttttcaaaattgaacctaattccatttttgtttactcagacatcagtcagtgatttgatagaatgcccttgtktatacaatgtcagtatgtttggtgcctacaaatggtattcccataataaattttattttcagtttacctggataacatgaagatatactgtggacacaat

SEQ ID NO: 113701 - DNA, 201 bp, Bos taurus; identical to SEQ ID NO: 32799

SEQ ID NO: 113702 - DNA, 201 bp, Bos taurus
aattacttcctaggcagttctggccctgggcgaagacagtgtgagtccacagaatgtgaccggactcctaaccacctcctcccctccctgttgccacctcrcagtcagggcctgtccaccagtcccgccccttccagtcctcaggtaactttataaggatgtgttatctgcttcaagaggtgtccctgacttttattctta

SEQ ID NO: 113703 - DNA, 201 bp, Bos taurus
tctcacactgtacggactatacctgcccattctttatgaactgtacatccaaagtcaagttgcgtaagaaacttccaaaaacataatccagattccggccrtggtaaatgtggcctttggagtcctgagccacaatactggtgcagaatctgggaaaagggaaaagtttaacatgagtgaacaacaaaaacaagaaaaagg

SEQ ID NO: 113704 - DNA, 201 bp, Bos taurus
tttttctctttttcaagagtgcatctcgtagcgccagctggaagataaaggaaaaatgatgtaaacatgatctagagaagaagaccactggaccagtgttyaaagtgaacctgtaaatatcctcagaaagtttcacagtccccaaaagaaaataaatggaatattaagtaaaagattatgaagaataaacctaaatataaa

SEQ ID NO: 113705 - DNA, 201 bp, Bos taurus
atagtggcattgagaaaaagatgtagtagaggtatgtaaaaacactgttttcctttatcactattcttcaaaacaagttttgaaaaatctgtgcacatcamaggtaatttaaaggccctttcccttaccattagaaatctaggtgtaaaggtatgaagaacagtgaaacgagtcaaagactcggatctggctctatactgc

SEQ ID NO: 113706 - DNA, 201 bp, Bos taurus
agctgatgggcattaactggcagcacccagcaccatatttgcaccggaactgatgaatggtatcgaccaactagaaaggcaaagtgaagggatgtgttgayctgttatctttgagaatcagagagcccccttttcagtacatctttcttttctcctaagttgttttctgtttgtagctcttattaaaggtgctggaagttc

SEQ ID NO: 113707 - DNA, 201 bp, Bos taurus
caaaggctggtgtagaaacaggggcctaatcagagtctgttactgggagcagtccaagaggaaagagaacaggaagggggttatggtggatgctgagcaargtggcctgattgatgcctcttagagggctgggggctacggcacaggccactggagggtggggcgccccatcatttcctggaagggcctttggaggaccgt

SEQ ID NO: 113708 - DNA, 201 bp, Bos taurus
tgaagctataagctgagatgttcaagggtgaaggacattacaaggccatcagattttgctttacctgctttaccggagcccaaacctggtcattggaagakatccctgcactgaatggcctggatcaactgacacttttgggtaacagcgctttggtcactgtagatgaaaataaaggagtatcattttttaaaaaagaaa

SEQ ID NO: 113709 - DNA, 201 bp, Bos taurus
cttttccccaggcctagaacagtgcctgactcttggtacatgctcaaaaaatatctgtgaacagaagtttctgacttccaggagtttaaaacccagaagargggacagagcatggccagaaatacctatgacaaaggcagagctgtggcttgtctccaggcaggcagaaatggtgtggaggagaaagagagagattctatc

SEQ ID NO: 113710 - DNA, 201 bp, Bos taurus
attcagtgtttcctttctccatgtggcctctacagaggttgatgttagtttaagaagaaggatagggctttagaagctgatgcaacctcacagtcacttaytccactggccaatgagagatttgataaaggagaaacaactatgaaggcagaaattctgccccaaatgatgaacctatgttttctaggatgattccaaact

SEQ ID NO: 113711 - DNA, 201 bp, Bos taurus
gcccagactctcctgaagctatgttttatttggcccacagaatggtggtgctttttttacttgaattcattttcaacattgaaaactggaaattttcatgygaaaattccagatggccttttttttttttaagaagttggagctcaaggaacagtgagcccactttctgcaaggcccaggcacttactccaatcccccagg

SEQ ID NO: 113712 - DNA, 201 bp, Bos taurus; identical to SEQ ID NO: 32804

SEQ ID NO: 113713 - DNA, 201 bp, Bos taurus; identical to SEQ ID NO: 32805

SEQ ID NO: 113714 - DNA, 201 bp, Bos taurus; identical to SEQ ID NO: 32806

SEQ ID NO: 113715 - DNA, 201 bp, Bos taurus; identical to SEQ ID NO: 32807

SEQ ID NO: 113716 - DNA, 201 bp, Bos taurus
aagagaatcaaatagtaaatcccataattctaccatcacatattgctattattatcatttgcatcagtttgatagggccaccgtaacaaaataccacaggmggagtggcgtaaataacagaagttaattttctcagagtcctggaggttcgaagtccaagatcaaggtgctggcagggttgttttttctgaggcctctctc

SEQ ID NO: 113717 - DNA, 201 bp, Bos taurus; identical to SEQ ID NO: 32808

SEQ ID NO: 113718 - DNA, 201 bp, Bos taurus
gagtttctgactttgaaggaagctataaatatctaaaatggaaaagtaaagtaccaggtagataaaagatcccgctcttaccctgacaatgactgaaatayaacaaagaaattaaaagaaaacgtgccaagtacttaaccttaagacaaaagatttcacagtcaagaagctaaaaatacggctaaaaagtcatcataattt

SEQ ID NO: 113719 - DNA, 201 bp, Bos taurus; identical to SEQ ID NO: 32809

SEQ ID NO: 113720 - DNA, 201 bp, Bos taurus; identical to SEQ ID NO: 32810

SEQ ID NO: 113721 - DNA, 201 bp, Bos taurus
acacttttagaaatcttttatgttatttttgaaagggacctaagatgaaatacctagactaaaaggaaatatataaggtacaaagttctagttagagttaygagcctgcgcagaaatagaaatgatagatgtgtgaaaaggagaaagagtgatgtgtgagttcagaacttttaatcagtggattccacacttcagcatttc

SEQ ID NO: 113722 - DNA, 201 bp, Bos taurus
gatgtagttaaaacaccacttagctgtaattttgtaattctcctgggtggggaagtggcggatggtggcagtgaaaccaaagcccagatttgagcaactgygggctgttgactttaggctagtctttcatgaagggaaccctcaaaacaccacggccctttagcaaacagtgtgcatttcatctaagcctggctggctttg

SEQ ID NO: 113723 - DNA, 201 bp, Bos taurus
agtgaagaaaggtctcagattgcaaaggagggaaaaaaaagcatttggggaagagactagggatttgggaggattgttttataattaaaggatcaaaagaraaaaggatgtaggagactgggtataatagcgagacagaagagcttgcaaagggcttggggtgactgaaatgagaagtcttgggcagaggtggggaactcg

SEQ ID NO: 113724 - DNA, 201 bp, Bos taurus; identical to SEQ ID NO: 32818

SEQ ID NO: 113725 - DNA, 201 bp, Bos taurus
actctctctcaaatagacagatagatattgcttctatggcctttatgtttgtgttccaccaaaaaattcatatgttgaaatcctaatgcccaatgtgctgrtattaggaggcagggcctatgggaccttatattgctgttgttcagttgctcattcgtgtctgactctttgcaactccatggactgccgcatgccaggctt

SEQ ID NO: 113726 - DNA, 201 bp, Bos taurus
acctgtttctgtttgtagcttccctcttctttctcctccatctagagagcagtgatcagttcgacaataaagaaaggctggcacgaggtgtgtgcggtgcrtgggtgtaatgtgtgggtctgtcagtatgtggcttcacagcaggaatgggactggatctacattagagatgagtaccctttctcaagtctccagaatgga

SEQ ID NO: 113727 - DNA, 201 bp, Bos taurus
tacttttctttttcaaggatgctaattatcttctcttttgaagttatagcctaataaccagttaattttgttctaaaatttcaggaatgtgttgttcttgraatagtcttgggtttgtgcaaagcacaggtggataaagtgtagacctcatgctgctgctgcttctgttactgcactttaaacagaaatactaaatacagc

SEQ ID NO: 113728 - DNA, 201 bp, Bos taurus
agcagcagcagcagcagcagggattcatatgaatgaaacacatgatatacactcttttgtgtttgcattattgcattttgcttgtttttgagattcatccrtgttgttgtgtatattattagttcattcttttgtattgcttagcaatgttccattatgttatatatatacaccacaatttgtttatccactcacctatta

SEQ ID NO: 113729 - DNA, 201 bp, Bos taurus
ttatattcaataaaaaagaaaacacaggagtatttcttccatagaggcagtgacagaaaaacatttggatcttttaatcaaaaggatatgaagcacttaakcttggacattcattatctctgcagaagttctggtgggcttgagacccaaggatggtgggcttgggagacatgcatggggctgaggctaaaaacccagcag

SEQ ID NO: 113730 - DNA, 201 bp, Bos taurus; identical to SEQ ID NO: 32821

SEQ ID NO: 113731 - DNA, 201 bp, Bos taurus; identical to SEQ ID NO: 32824

SEQ ID NO: 113732 - DNA, 201 bp, Bos taurus
aaggctagttttctattcctggctctctggattggcagtcatttggtcatgtggtaaatctgtgtctcgtttgtctgaggtataagctacctgtatatcayagagatgcctctttatcttcagggtccctgcctgctaaccattcaatttgaattctgctgctgatggctcagcagtcattgaatgccactgatacgtggc

SEQ ID NO: 113733 - DNA, 201 bp, Bos taurus
tttttattttcttcatattcagttgcagatatggcagtcttctcaatttcatgagaatattttgttgaccttaacatttatcggttttgtgaattaggaaygatagcatgacatattattaatgaaatcttgggatgcatttcaacagtctagcaaaatgtcatctttcacccagcagaagactgactcaagagaaatgct

SEQ ID NO: 113734 - DNA, 201 bp, Bos taurus
caatagttggatataaattgattctatttccttgcatgttccttagatgaaaggaactttcactccctgtcttcatgtatttatgatttaattgattatcwttttatctttgaaattaaaatccttggttataaagacatggctgtagtggagagccctgacaaaagaggtatacattggagggtaggagtgggagaagag

SEQ ID NO: 113735 - DNA, 201 bp, Bos taurus
tgttttcctgagctgtctagtctgaagtttatcaatattcttggtcttcttagagaaccagttatttgtttcattgattttcttattaattttgtattgtktatgcctttgatgtctgccctttatgattttgtttctcctgcgtactttgggtttattttgtgtgtgtgtgggtttcttcttaagatgagagtgtaggtc

SEQ ID NO: 113736 - DNA, 201 bp, Bos taurus
gtcatatattatggccactaatattcttcagagggtttagagaataacagcccatccttcccctgaaagctcactctcttcttcaggggtacagacaggarttagagagggaaaaagagggcctctgcctggtaggacaaaacagcagccttaaccttggctactcaagtggtatgagatgccacattctcaaacccttcc

SEQ ID NO: 113737 - DNA, 201 bp, Bos taurus; identical to SEQ ID NO: 32825

SEQ ID NO: 113738 - DNA, 201 bp, Bos taurus; identical to SEQ ID NO: 32826

SEQ ID NO: 113739 - DNA, 201 bp, Bos taurus
tcactctgacaaaaatcactgtctgaagtataaatatagatatgaagcgaaacttgatgtagccaaaaatttggcataatttcttacccagaataaaaaakaaaatttgaaggagtatttgaaaaatcctcaacttattgtaaaatcaatttagcccatttgtctgaagttattgttattgctaagtaagaatagactgca

SEQ ID NO: 113740 - DNA, 201 bp, Bos taurus
aaaaaataagcaaaatttttaggttctatatgataaatacttaaattgcaaaataatggctaccattctccactttgtcgtgtatccatgtccctttgcartgatactttgcatctgctcccatcaagagaagtcactctgcctgcctctgaaactgagctgctttgtgacctgctttgggcaacatgtggtgatggtggt

SEQ ID NO: 113741 - DNA, 201 bp, Bos taurus
cttaaaattcttcctaagatgaacatctcataattccatctttaaagagctgtaaaatattaagaaccatacaactcaactctcctttttctttccttcargtactctctttgagatattttatgcctgaaattaaagaggttgagatatatgaaaggtggagacagtggtaaacaggatgtgtttcctttgtacaacaca

SEQ ID NO: 113742 - DNA, 201 bp, Bos taurus; identical to SEQ ID NO: 32827

SEQ ID NO: 113743 - DNA, 201 bp, Bos taurus; identical to SEQ ID NO: 32828

SEQ ID NO: 113744 - DNA, 201 bp, Bos taurus; identical to SEQ ID NO: 32829

SEQ ID NO: 113745 - DNA, 201 bp, Bos taurus; identical to SEQ ID NO: 32830

SEQ ID NO: 113746 - DNA, 201 bp, Bos taurus; identical to SEQ ID NO: 32831

SEQ ID NO: 113747 - DNA, 201 bp, Bos taurus; identical to SEQ ID NO: 32832

SEQ ID NO: 113748 - DNA, 201 bp, Bos taurus; identical to SEQ ID NO: 32833

SEQ ID NO: 113749 - DNA, 201 bp, Bos taurus; identical to SEQ ID NO: 32834

SEQ ID NO: 113750 - DNA, 201 bp, Bos taurus
tgtggcacccggtctatgccacagcctggcctaaccagccttcaaggacagagcatcaaacaaaccataagtcctttggagtctagagaggagtgcaaacrtgtgaactgcatctatagcatggccaccattgcccacgattggggaaatagagggtgcacagagatgaggtcccccaacccaaagtggggcaagtcacgg

SEQ ID NO: 113751 - DNA, 201 bp, Bos taurus; identical to SEQ ID NO: 32837

SEQ ID NO: 113752 - DNA, 201 bp, Bos taurus
atggtggcatctgagcagaactgacactgctgatcagggaatgtgtgccaacaggtaaatattttccccatggatatatcaatgatgagtatacacagctrgagcaattgtctaacacaggaactcatgctaagtggatcttcaacaaggaaagcaatgtgttttttactgcttttattttgcatttttataattctatgc

SEQ ID NO: 113753 - DNA, 201 bp, Bos taurus
aatatttgtagtatattgtattcatgatatgatatgaaggatttgttttgaaagggtgcatattttaaattttctacctctgggattatcttttctacatrttttgagattcctcattctcatatatatccagtttaacatttgaacatgtctgttgcctatataaccatttggatatagagtgttcaaaaatcactagat

SEQ ID NO: 113754 - DNA, 201 bp, Bos taurus
ctaccagagtagccctaaagacatgagactcagaggcaattgaggcttacatactattctaagctaagaaggaggtagggtgtgggccctcaaagtggagraagacaagtcgtaggatgaagaagagagtaaatgtttactctgacgtgcagataagtccttctgttattaaaaagttatctctggtaattactcttttgc

SEQ ID NO: 113755 - DNA, 201 bp, Bos taurus
tacaacaacctaatttgaaactattaatctctctgtttacaaatgacaaagctatttgtttctgctccagaagagagcagagttgggaaagaaaatgcatrtgagtcttgattaaccaagtgtttattacttgagaaacttgctgatcattgtggtacccacagcaagcagttgccttaccagtggaaaagatgcactaat

SEQ ID NO: 113756 - DNA, 201 bp, Bos taurus
gtaaagatgtagagaaatgtcatggaatccaagaaggaagtgtatcctggatccttaggactcaggaagcccattttctagatctgaaataccttaggaamcagagcagcttgcagtctcgccatttctttctctttctccatctctatctctttcatttctttgaggataatggggtcttttgtctccacttcccttggt

SEQ ID NO: 113757 - DNA, 201 bp, Bos taurus; identical to SEQ ID NO: 32838

SEQ ID NO: 113758 - DNA, 201 bp, Bos taurus; identical to SEQ ID NO: 32839

SEQ ID NO: 113759 - DNA, 201 bp, Bos taurus; identical to SEQ ID NO: 32840

SEQ ID NO: 113760 - DNA, 201 bp, Bos taurus; identical to SEQ ID NO: 32842

SEQ ID NO: 113761 - DNA, 201 bp, Bos taurus
tagtactcaatgtgccatcagaagcagttccacttaataacctgtactgaacataaggtttaaataccattgtttaaaaaaaaaaaatcaaatactatackacgacaatggccttgaactacattaagcagtttgaatctaactaaacaaaaatatcataagctacaatcattctcaaaactattaagaatactatgaaaa

SEQ ID NO: 113762 - DNA, 201 bp, Bos taurus
ttggagcaatgtttctcaacagaagagcaagttacatttgggcaggacagctctctactgtgcagggctgtccaatgcatcaagagatgtttaatgtaccyggcccttactctgtctacatcttagcattttgtatcttatcttgccttgatctcaatgccagtgggacgtgaacatgtgagtgattagtttgctaaccat

SEQ ID NO: 113763 - DNA, 201 bp, Bos taurus
tctgttactgaaatgggaaacactccttgactttatcccaaacagcggcatctttgtgctagccaatgagtttaactctgtattaggccaatctacagcartgggattgtgggggcaagtggaggagggctgggtgagaatccagggtactgatctgtgtgtagtcacatagcaccagctcaggggcccataagaaatctg

SEQ ID NO: 113764 - DNA, 201 bp, Bos taurus; identical to SEQ ID NO: 32845

SEQ ID NO: 113765 - DNA, 201 bp, Bos taurus; identical to SEQ ID NO: 32846

SEQ ID NO: 113766 - DNA, 201 bp, Bos taurus
atatatggataatggcccttttaattcccattttccttatgatatcatcacgtactgtttgtcaaaatgttcttggaggaaaacaccagagctcagagatyaggccaattattgtggagactcttttgaaagaatattatgcttccctctgctcaagggtacatggcacatcgtaggacccagaggaatctacactaggtt

SEQ ID NO: 113767 - DNA, 201 bp, Bos taurus; identical to SEQ ID NO: 32847

SEQ ID NO: 113768 - DNA, 201 bp, Bos taurus
gatcatcaagtggtgataagtgctttggaaacaaatgaattgaatgcccagaacctgtttgctgctcctctgcagattgggcaggtgagggccggacaagygtccaacgagggggcaaagctggtaatttgttgttgctgctgcatgccctctgggtgagaagaaaatctgtccctgaatgcttagtgagttggcttggcc

SEQ ID NO: 113769 - DNA, 201 bp, Bos taurus
cctctgtaagggaaggtggaagtgggagacagcagtcagcaattaagagtcccaacctttttcttttttttaaatcttagaatcggccttataataatttyaaaaaaatcaagtgtctactttgaattaaggcctatgtggagaggaaaaaaaaaaaaaaaactgccccaagatgctgctcagggatgaagattttttaat

SEQ ID NO: 113770 - DNA, 201 bp, Bos taurus; identical to SEQ ID NO: 32848

SEQ ID NO: 113771 - DNA, 201 bp, Bos taurus; identical to SEQ ID NO: 32849

SEQ ID NO: 113772 - DNA, 201 bp, Bos taurus; identical to SEQ ID NO: 32850

SEQ ID NO: 113773 - DNA, 201 bp, Bos taurus; identical to SEQ ID NO: 32851

SEQ ID NO: 113774 - DNA, 201 bp, Bos taurus; identical to SEQ ID NO: 32852

SEQ ID NO: 113775 - DNA, 201 bp, Bos taurus; identical to SEQ ID NO: 32853

SEQ ID NO: 113776 - DNA, 201 bp, Bos taurus
cactccgaggcagccgggaagggcgggcccgaggagcggggagggtggggtgcaagccgggggcgtaaccaccgtctccaatagcgctctgcctggggcckcgcgtctcctccgggtcacgcccactcggaagcgccgcgccttccgattggctgaagggggctagccgtaggaccgcgcccgcctggttcccgccccctc

SEQ ID NO: 113777 - DNA, 201 bp, Bos taurus
atacattcacaattgatatgaaagttttccattgaaaatacaaaatcttactgaaatatatatttcttctaatggttgatttggctttgtgcagtgaaatrtagcccatctatttttccaacctaacatagccagctttaacattcttcagctcagatcagtccttagaaactagtattctcttacccttcaaaaagaccc

SEQ ID NO: 113778 - DNA, 201 bp, Bos taurus
ttcttcaggggatcttcctgacctaggaattgaacccaggtctcctgtactgcaggaagattctttactgtctgagcccccagggaaaagccccagggaakgtagctaaggtatccacttagtgatattgccccctcgcttaccacatggatgggaaaccctaaaccctgctttggcgttcatcacgtggtgtcagaggga

SEQ ID NO: 113779 - DNA, 201 bp, Bos taurus
gcttcccaggcccttactgacagcagagggttaagcaggtcaggtcacactcaaccaccagggaccagccaggttttttgctcaggggagctctgctctawgaaccagcaaaggcccaagaagaaaagaatactgctgaaggctctgtccctcaggaaaacaggctgaaagaagttgagctgaaagaagtgaccttccggt

SEQ ID NO: 113780 - DNA, 201 bp, Bos taurus
ttgtgtctttctgatagtaagtcttttcccttagcaacttcctcatattgtcaaactcatgctgaattctcaatgtacaaaaattagtcatggagagatcrtctagagattgaacttaaagccccgttcctttctacgaagagtcttggaccagttgatctaaatcagcgagaggtacttctctggagactcagtaaccca

SEQ ID NO: 113781 - DNA, 201 bp, Bos taurus; identical to SEQ ID NO: 32854

SEQ ID NO: 113782 - DNA, 201 bp, Bos taurus
tcctaaattccaacaggaaaaaaaaatgtctaagaaaatgcatatcaaccagcccgagaccagacccttaaacaagtcaggcgaaggaaaaatgagtacayctactataatcagaaataagactcctaactttatggaccacttgaaggaaaatgatgttcatggccagaagtcatgataaatgttgaaagagatactttc

SEQ ID NO: 113783 - DNA, 201 bp, Bos taurus; identical to SEQ ID NO: 32855

SEQ ID NO: 113784 - DNA, 201 bp, Bos taurus
tgacggcatcagaacttgagagagatgaagttgccacgtgtggtttcaggtcagcaacgtttttaggagggtagacggggggagtagaaacagaatgataygcgtgcctgtgaagaagaaagaagggtaattgggtatttaatttcaatcatagtctctgttcattttcttcatcttctattactttaatgttgggaaatt

SEQ ID NO: 113785 - DNA, 201 bp, Bos taurus
gaagggaggatattattatggaatgattcatgaaactttcccaaaattaaaggatatgtattcccaggtccagggtactcagcataatgttcaaaaataartccactccaaggcatgttatcatgaaattttagaacaggagggtcaatggtaggattttaaatgtttctataaaaaagaatcaaaacaaaaacaaaaaaa

SEQ ID NO: 113786 - DNA, 201 bp, Bos taurus
tccccatccaccaagggctcctgtaaggtcatattcagcaaaaggtcaagtctttccatgtcaagtgaattattgaacacgtgtggtactaaagggctagmgggctgaaaatactctgctgtttttcttaattagttgtggtggtttaggtttcttaaagcaggtcgtttatatcatggaaattcaggatggctcacacac

SEQ ID NO: 113787 - DNA, 201 bp, Bos taurus
tctgttcacttcttcctgatatactttcctctccttctttccctaggagtaaacactagcctggattttgtgattatcagtgtcatatgtgatggaggtcmctgtctgcttccaaatcaaagcccagtagaaagtggctttagctctgctcactgctttgcatctcaagtccatagaaattacatcagacacctgttaggc

SEQ ID NO: 113788 - DNA, 201 bp, Bos taurus
cttatattttgttttcaactctgttccaaatactcattgttcaaagtatctatctaatcataatagattgctaatttggtgctttaactagttaacagaakatatggggcctttggatcacaaaggagatttaatgttcagatgccaaaagttttaggtattttgccaaataaataagtggtcaatctatgacaagcaata

SEQ ID NO: 113789 - DNA, 201 bp, Bos taurus
gaatgagtacaaattaaatcattaattaggtctcatctagaatctaaacaaaggattaggggaacaaacggaggttttaggacctgagtgactggagaacygaaacagactaaacaatcattctgactctttggtgagttcaacgtaccttctagtaatgaagattggctacaacagatcaagattgagcttaatgtttct

SEQ ID NO: 113790 - DNA, 201 bp, Bos taurus
agtatcttgcttgtttgggaagaacagtggtttgcattgcctcagacgtaacacattatttcaaagcaaaggcgataaggcctcatcttgtgaaccctacrgaataagatgagggaaattgcaggcagccgttttgacttttcgcctctagtggacttcccacatggccaccatgtaaatcaaattgcattgttttgggaa

SEQ ID NO: 113791 - DNA, 201 bp, Bos taurus
attcatgctcacaggctcagagaaaagagattgtttagatgtgcaggccttgttaaccatgagcaaagtgaaatgagttggcatgacaacctgcaaacatrctctagcaaaatagtaacagtaaaaaagtaaataattaaaaacaaaggaaggaagatgaaaacaaatgaaactagcctgtcaaatatagattgaaaaaat

SEQ ID NO: 113792 - DNA, 201 bp, Bos taurus
ataatctacatataaagaaagaacctcacaaatcctgaagctatttagattttctatattttttttttcctctctgtgtctccctccagctgaaacagccrcccaaagatataataaaatcacctgtgtaatttattttctcagtctagtggaaagtcaagtcctgaatgacgctgtatgacaccatcagtgtatttccag

SEQ ID NO: 113793 - DNA, 201 bp, Bos taurus
agccaatgcactcctcatcttcaaggctttcatctcttttgcaaaagttcttaaagtaccactgcactgtactttcattagcagttcctgggccaaatgcyttatggatgctgtgagttgcctttgctgctgtatgacccattttgaatccgaataagaaaatcacttgaatttgcttttggcctaacatcattcccttag

SEQ ID NO: 113794 - DNA, 201 bp, Bos taurus
tgacttcttagtgcataatatatcactccaaagtcaactgaatgagtctgtccttgtaagtaactcaatgggagacatttcaaagcttgccttaatcacgyccattcgaaaaaactgagtaaaaacctgacatgcgtgttgttctcctcacttatgcatatctaccgggttggccaaaaagtttttctgtgttacagaaaa

SEQ ID NO: 113795 - DNA, 201 bp, Bos taurus
agatttcttgaccaagtggacaccctaaagacaaattgagccaagaggtttatacctgagggaatcatctgagaaaacatcatgattatacaacgaagccktaacaaactcactcctgactgtatagcctacacatcattgaaccctaatgggaatgttaaataaggatattaaatgactgtactaaaaaaagcttcatgt

SEQ ID NO: 113796 - DNA, 201 bp, Bos taurus
attatatctgcttcctcaatgtaatcataatcagactgtaataagaatcatgatgtgaaataagtacaaggttaatttcatcaatcctccacagttatggkttatgcattgattcatagcgcagcctatatacccagagttatataagccaataaacaaatgaaagagagatatcgatcactcgttcaaaacagcttcttt

SEQ ID NO: 113797 - DNA, 201 bp, Bos taurus
ggcagaagaggcctttcaaagatgtcgtgtaactgggaaaaacaacttttaaaaaatatgatatggctgtgaactgctcagcagtagctaatagaacaccyggagttcctctgtaaggaaggtgaccggctttttatccagcaaaagttttaggcaaatccacacgttatcagaagtgatgccagtgccacactggtcaga

SEQ ID NO: 113798 - DNA, 201 bp, Bos taurus
gatccctggtcagggaactagatcctataggccacaactaagagttcgcatgctgcaactaaagatcctgcatgtcgaaactaaaagatccttcatgttamaaagaagactgacgatctgcctgcctcactaagacctggtatggccaaatatataaatcttaaaatcatttttttaaaaagatctcaatagcttttaaat

SEQ ID NO: 113799 - DNA, 201 bp, Bos taurus
taaaactcccagcagcaattgctctgtactgcactgcccatgcccagaatataaagaacatgctgcatcctcagcacatcagcggggccaggaactcacaracaacatttacagaaggcaggatgcagcccgaaaggactggagggtaacacaaggaccggatacccatcccctacccagcaggacagtaccatgagtttc

SEQ ID NO: 113800 - DNA, 201 bp, Bos taurus
acatatgcttgtttcaaataaaagaatacagaaaggagatcagctccatgccttaaaacagagaaagaaaaaatgtcaacatatataaaacaattaaaggmaattaaacatgtactgaatcactactataagcaaagaaagcatttgccccttacaacttcccagaggttaaaaaaataagtcctatcaaaaatatgacaa

SEQ ID NO: 113801 - DNA, 201 bp, Bos taurus
ttaatacagaatgacatctactgctttatttcatactgcagtataaatttaacccccaatttttagattcagtagatttggatagattcgtaagaaaggtyaggaagagaagacaaacatcactttctccttcagtattcaacttttagtattgaggttgtttgggtttttccataagatcataggggaaaacccaaaaga

SEQ ID NO: 113802 - DNA, 201 bp, Bos taurus
taagtaccaaccgttctttcaatgaccatctctcgaggacttagatattctatattaggccataggtttacagagatattgaataagaaatagtctttgcyctcaaagggaaaatagtaatgtaagtatcagtaatggagagacagacaaaaagcaattaataataataataatgaaaatacgaggatagtaggtctgtac

SEQ ID NO: 113803 - DNA, 201 bp, Bos taurus
atgttatgcaaagtactttaaaaaattgtataattctgaatctcatatttaagtttcctttgatgttaaatatcttgttggttgacattaaaatatttagytcttttcatggtttcatttttacaataacatgagatggatttacaatatcttaactgtatatttttaaaagtatatttgtgatccttaagtcaactggct

SEQ ID NO: 113804 - DNA, 201 bp, Bos taurus
caggatgccggtgctgcctcatttgctacctgatatcacatttacgtgcaacagagaggagttgggtaatggcaaattcaagctttgggtagtgtgacttytcttggatagattaaaagtacatactgttaagcctaaggaaacaaatatttttctatttcctgaaggtttttccttatctggaggtcgtgacagccttca

SEQ ID NO: 113805 - DNA, 201 bp, Bos taurus
gattacatgatatactttatgctcatcacagatgtggctggagaattggtattgagctggtagcatcagcagaacagaaagtgagatgtattttatatatrtcaataaaggaatgacctgtttttatcctacagacagtgcaaattggaagtcaaataccctttgtattccaaaataggacctcaaacatcttgtaatttt

SEQ ID NO: 113806 - DNA, 201 bp, Bos taurus
ggtgagaagcgtgttctttggtgttgacttcacatttggggctaacgcaggattatgaatctaagcacgttatggaattttagggctattgttacacctckctaaggaccttttggatgtatttttagcggccactggtatcacccaggcttttgtgcttctgtcagttctgggtagagacttgagagtgttaggtcagcc

SEQ ID NO: 113807 - DNA, 201 bp, Bos taurus
ctatttttgaatcactaaaagcctgtgcattaaatggatggcaaagtagttttgccagagccatctttcttggtccctctgccccaagttgcttatccgcyaccctccagaggtattgtaaagataaacagaggagactgaaagtctcaggcactaagtctatctggaggatatatgctgtttactggattgctgagtaca

SEQ ID NO: 113808 - DNA, 201 bp, Bos taurus
cctagtggctaagactctgtgctcccaacgaaggtggtctgggttccatcgctggtcagggaactagattccgcatgctacaactaagagttaacatgccrcaattaaagatcctacaggccgaaactaagatccaatgcagccaaacatgtaaataaatatttaaattgactactcttctgagggaatccatttgcaact

SEQ ID NO: 113809 - DNA, 201 bp, Bos taurus
gtataaccagagtgaaacagagacgataataggagttattaaatatgaaaagatgactgtgagcctttctgataatcaaaaatatacaatcacatagaagygctgtcttttcctatcatagtggccaagactaacagcgctggatcactgaaaaagcaagagggttccagaaaaacatctacttctgctttattgactatg

SEQ ID NO: 113810 - DNA, 201 bp, Bos taurus
agtatgttgaatcatctcagacttccatataatgagggcctcctactttgaaatgtcacctttccctcaaatttctgtccttggtcctcaggattgttacyttgctgaacttggccagcagaactcaggcttcattttttttaaattaatttattctttattgaaggataattgcttcacaatcaggcttcatttttttct

SEQ ID NO: 113811 - DNA, 201 bp, Bos taurus
ccaacaaaagtcaggccctagaagtgttttttcaaagttggtggtttttcaagcttttattgctaggactcccttttaccctagtgaaagctgtggccaarctcctaaagtccatccatgaacctcccctcccccaagggattccatgaagttaagaacctttgattcaggttaagggccagggaacacattcatcagtcc

SEQ ID NO: 113812 - DNA, 201 bp, Bos taurus
aaacaagagaacatcaactgatagcccttgaagttgatctctgaactccccctggttcaggatcccatctccaccagacctacagggcaccaggccctctmctcagcatcaatccctctcccgctgaattggtttctgcctgagctcatctccccctgtgcaggtcagctcaccccggggcagggatgacagctgcactga

SEQ ID NO: 113813 - DNA, 201 bp, Bos taurus
aagaagcgccaacttttgggcatgagagagctgcaatccctgcctccagctgggttcaggttaggaagggtcttggactggggtcagaacagttggacttygagtcctaccttggccagctattctgtctttctctctcccagcctcagtttctcctccaggaaatggacatcataaataggcaggtgatacagcaactga

SEQ ID NO: 113814 - DNA, 201 bp, Bos taurus
ttcaagtgttctgcctagtgggtgctggtgagccaaaaccaggctcaacccagcggtgtgggtctcatgagcaaagagcagggctctgggccaaagagggragtgagggtggcttgccgtgaggtggggaaaatgcaggtttgaggtcagagttgagcaagaatcctgctctgcctggtgactgctaggtggccatggaca

SEQ ID NO: 113815 - DNA, 201 bp, Bos taurus
gggatcgccggcctggaagttcacttcttgcatcccttactttaatcgcgtgcagtttcccacctgcttaggatgttttcgtctgcgcgttcatttttcaygccagcggtttcctttcctgggggcctcgggagccctggagtggtgtgtctcgcgcgcctcactagccccagttcagggctccggggacagataatgaag

SEQ ID NO: 113816 - DNA, 201 bp, Bos taurus
tagcttggaggagctcagcagcgggaccccagctcctcctgggcacaagtcgccgggtccactgcgcaaactccggcctcctcgaaactctcctcctggcrgaacagctcccggcaacgtccccgggctggggcggggcaagcgtccggccctaccctctgactggcaggaggacgggccaaccggaggggcgccccgggt

SEQ ID NO: 113817 - DNA, 201 bp, Bos taurus
cagtaacaaaagaaccctgaaaggtcagttctaggtcacccgtgcgctggggcaggtccactggagctctcttccaacagtgatccagggatccagccctycccatctgctcaggccacaagctctacacttgacttgtgaggtctgtgcagcaggaagagagagaagaggaaacacatgggctcttacgtgcctttgcac

SEQ ID NO: 113818 - DNA, 201 bp, Bos taurus
tttacagtactggccaaccttggcattgtttttctgggagggtccaagtccagttcacggtgtggctctgtagctgtcagttctgagaagcagccgtgccytgggtgctcagaacctgggcctacccaggcccggtgcagacaggtaggcgcagcaactttgtgagttacgccctcttggagccagtgggtcgctgggcgt

SEQ ID NO: 113819 - DNA, 201 bp, Bos taurus
atcatcatgcagcgatgagcaagcatctttaatcataagtttctatctatgttttaaaacacttccacaggatagattctagaagtgcgatcactgggccratgggtaagagggtttttaagagctttgacactgttcagtcgtttccagaaaaatggtaccaagtcgccttctacatgaacgctaccactgccggtttct

SEQ ID NO: 113820 - DNA, 201 bp, Bos taurus
cacagctcaggccccaccctggaactgatgggtcagcaactctggggcagggcctctgggatccacagggcctccaggtgatgctgatctgaatttaggartctggacagaaagtttccccaggcctgaggatgggtctacaagcttaattcgggctgatgtaaattgcctggccatcagtccgacagccttttcccaagg

SEQ ID NO: 113821 - DNA, 201 bp, Bos taurus
ggtacggaagagcatagcaggaccaggagttgagacaggagggtcccaaggaggacaagttgtcagaaccatggcgtgaaccaaagtctggaagccaaggrggagcaggactttgagcaggagaggctcaagtcagggtttcggggatatcactctaatcaaatgggaaagagagatggtgtagggaggtggcaagttaga

SEQ ID NO: 113822 - DNA, 201 bp, Bos taurus
gcagaagtctgcatgatgcaagtttccttcccacccctgtttcgggctcccctcccaagaggcaaacgcgacccagcttcttaagactccttccagagacrctctgtatatcctgcacggtcacctcccacgtgtgctcacccctcttccaccccgaggagcattattacacactctggcctgtgctttgcttatttcagt

SEQ ID NO: 113823 - DNA, 201 bp, Bos taurus
cgtaaaatatccttttgttgggtgctctgtaatcttggcctgtgggactttatcagtgtgaagaatcctgtgtgtctccacttcagccataagaatgttayaggctcagcaatatcaggcccaggaatttcaggaatatcactggcctgtgggtgttaggatatcaggcgtatcataaccagagtttcactggctcaggaa

SEQ ID NO: 113824 - DNA, 201 bp, Bos taurus
ccacggctgagtccttaacctctctgggcctccgtttcctccactgaccaggatatggcctgtcagtctgagtcctccacctggcccctcctcacctctcrcaggtcagcacttcggggaagctgctcgccccgaggaagctgcgacccaggaacctgtcgtcgctggcggctgagtggacgctggaagaggagctgcagt

SEQ ID NO: 113825 - DNA, 201 bp, Bos taurus
aagttaaatagacggcctaaagtcacagagctagaaagcagtagacccaggattcacatcacaaagtctagactaatagctttcacaccacagctgcctcygcagggctcaggctccagcctggccttttaccaggagccctgcattaaactgtcaggggcttgcaccattgtgaacattctgatactctctgagcaccca

SEQ ID NO: 113826 - DNA, 201 bp, Bos taurus
tttcaaacatctgcagcattgatcttccctatcctattgggcaggactacatcataagtccatgctaaactgttcacctgctaggaggctgaaaaggccaygattgtcttagactagagggcagcacttcttctttaggcttcgagggctacatggtttctgtagcagctattcaactctggccgcagcgtgaaagcagct

SEQ ID NO: 113827 - DNA, 201 bp, Bos taurus
gagtgatgtggctttgaaccaggagactggtgaaataatctaagccaagaataatggtgtctggatggaaaaggaatagcagaccccaaaagtgtctaggrgatgatcccagcagaacctcaccaagggaagcagagaaagaacgcagtggtgacatcagtggtgaccacgtgactgagcaggagctggtggtaccattct

SEQ ID NO: 113828 - DNA, 201 bp, Bos taurus
cgtgggtgagagtgagtgaaggggagaaaagagaggatgttggtccagccaacaaggcagagttagaagggtggcctcgtgggcaagtctggccaggccargagcccagggggagagatagctcctaaactgttttgaatccacttctggtctcaaagccagagttcctgcagctgctctgtacttccgcctgtctggccc

SEQ ID NO: 113829 - DNA, 201 bp, Bos taurus
ggaatacgacctcgctgtctttttcttcttccttttgcattttcccaagtaaatgtcttgaaccactgattagatctatgtgcccacaataacataagcargcatgaagcttaaatctgatttaaagcagtattgtacagactgttactccattaaagtccttcagagtctagattaaaatagaacagtatgaagagcgtg

SEQ ID NO: 113830 - DNA, 201 bp, Bos taurus
tgtgcagcagcgtagccaacggtaagcactgatgatgacagtgatcatctgacggtggccgtgctcagtcagtgcttctcttcatctggcctttgctccaygctgtgaggcatacagcgtgtgagtggttatgacagtgcactcggtctctccctgatgcctggaggcctcatgcccctgccgccccccaccctcccgggt

SEQ ID NO: 113831 - DNA, 201 bp, Bos taurus
catccaacctggccaacgggacgccttgggaggaagccggggagtcagataggagtgcagagaactgcgactccagcctgaaccgcacttacgccatctcrtcctcactcatcagcttctacatcccggtggccatcatgatcgtgacctacacgcgtatctaccgcatcgcccaggtgcagatccgtaggatctcctcac

SEQ ID NO: 113832 - DNA, 201 bp, Bos taurus; identical to SEQ ID NO: 32881

SEQ ID NO: 113833 - DNA, 201 bp, Bos taurus; identical to SEQ ID NO: 32882

SEQ ID NO: 113834 - DNA, 201 bp, Bos taurus; identical to SEQ ID NO: 32883

SEQ ID NO: 113835 - DNA, 201 bp, Bos taurus; identical to SEQ ID NO: 32884

SEQ ID NO: 113836 - DNA, 201 bp, Bos taurus; identical to SEQ ID NO: 32885

SEQ ID NO: 113837 - DNA, 201 bp, Bos taurus
ccccgctacggcccgccacgtaagccctgggactgggaccccgcttctcagcatcccccactcccgtcagctctgcaaggatgctgacgcccaccaggccygtcgggaacctgcaggggctcgttcacgtgaaacacagccactcaccgttccggtgggggtctaggtgctgctttgcagaacacgtctcccccttgatgt

SEQ ID NO: 113838 - DNA, 201 bp, Bos taurus; identical to SEQ ID NO: 32888

SEQ ID NO: 113839 - DNA, 201 bp, Bos taurus; identical to SEQ ID NO: 32889

SEQ ID NO: 113840 - DNA, 201 bp, Bos taurus; identical to SEQ ID NO: 32890

SEQ ID NO: 113841 - DNA, 201 bp, Bos taurus; identical to SEQ ID NO: 32891

SEQ ID NO: 113842 - DNA, 201 bp, Bos taurus; identical to SEQ ID NO: 32892

SEQ ID NO: 113843 - DNA, 201 bp, Bos taurus
tgcattgggagctcagtcttaaccactggaccaccggggaagtccccaagattcttccctttcttaaaaaaatactgtttcatggatgcgtttatttcctygctgctcaggccctgctctagttgcactgagcaggcggtgcgcaggcttctcattgcggggctcctcctgttgctgagcacgggcgccggccgggtcttg

SEQ ID NO: 113844 - DNA, 201 bp, Bos taurus
cacgagctccacgctgggcaggcatcaaggaaccagaaacacatgtccggccaactcagtgtccccgtactcctatgtcctgcatccaatcctcgggctgmtctcccctctgctccgtgagggccccgccgtgggccggcctgggggtccaggcttcctagaggagcgggtgtgccgggagggggcctctctcctgaaggc

SEQ ID NO: 113845 - DNA, 201 bp, Bos taurus; identical to SEQ ID NO: 32893

SEQ ID NO: 113846 - DNA, 201 bp, Bos taurus; identical to SEQ ID NO: 32897

SEQ ID NO: 113847 - DNA, 201 bp, Bos taurus
tgccagcagtattaaacatcagcactcacgtattcctttaagcagggctggctcttaatgaccaggaggcactgtaaggccactaactacgacagaaggcrcttgctacagcctcctggggcttgcttcttttatcttaacctgacaatgactacaaaacactctaacctatggtgggttgaattctggccccatacacat

SEQ ID NO: 113848 - DNA, 201 bp, Bos taurus
tagttcatggggtcacaaagagttggaaacgactcagcgactgaacaatagcaacaagaggttaggtggcttagaatgacagactgggccccagttcaggrgctttgggtgccaagctgaggaatttaggcttcatttgctgaacatgggatccattgcctggccaggtggcaactattaatatttacaaaattaggcaat

SEQ ID NO: 113849 - DNA, 201 bp, Bos taurus
ctgactcttgtccaattgctcccacacctaggtccctttccactctcccctcacctctctgagccctgaagctggtcctcctgagctgcaccaatgagacrcctgggttttcaggcttccacttgggtttgaccaatgagaggcgcctatgcaggctggagggccagcagaaagaacagccagaatatttcttcccagctc

SEQ ID NO: 113850 - DNA, 201 bp, Bos taurus
gagtgaaaaaacagtgcttttctgcacagatggcgcctggatccctgaggcatgtctgcaaagtcagggctcctgggatccctttgagatgcactgattcrgcctccccctctgttttgcacacagcataggccccccaaacaaggagaagccttacaaacactcggcaaagtccacagcctgcactctatctgcctcttt

SEQ ID NO: 113851 - DNA, 201 bp, Bos taurus
aactgacccttttagagcaagaccacctgttctgtttgtcctgattcctgttcacttcagctctgtgggcaaagacctcgctgaaaggacaagtctatcckagtgagaccttgatgttagacatacttctcaggttctttttagcagcccagcatccagacagaattttcacttgggaaagtgaaagcgttagtcactcag

SEQ ID NO: 113852 - DNA, 201 bp, Bos taurus
cacgcctcccaagccagggccggatgagcttccggggtcctggcaatggggtcctctttcacccatccactgcccagggacccccccccccaccccgagtrcaaggccacatctggacgaccagcactcacacttgacaggactttaagtggcaatgatatccaagaaaaaaaaaaaaaacctagcctaagccctttgaca

SEQ ID NO: 113853 - DNA, 201 bp, Bos taurus
tactctcaagacccttgcctggcttgcagggccttcactttagtgcccaatcctgtttttgcatgacaaagctcacatatcgctttgccttgttccttctytttgcattctgtctgggacaagctctcatttttgcctccaagcaagtgtatgctagtgaggacaaagttcatgcacaaaggcaaaagaataaaaattctg

SEQ ID NO: 113854 - DNA, 201 bp, Bos taurus
gttcagtccctggccaccaaagctttaggtacattcacagcaaagatcaattctcctctttgaatctcttgtctctgtgtttacatgtttgtggcttattwatttcatttacacataaggcctaatatcagtttcccatcttttcctgtagatgatactcaagaaatatgcttggatttgtattgcttcccgcctctagga

SEQ ID NO: 113855 - DNA, 201 bp, Bos taurus
ccaaccaccataaaacaatgacacccgacaccaacaatagcagttttttttgccaatattaataaaaacacatcatgtcttaggctccatgatttacatgyattttattattttatgcaacaactcaatgatgtgattgactaaacaagctgttttagagaaatgggattcctttctcaagatcatacaactaacggatga

SEQ ID NO: 113856 - DNA, 201 bp, Bos taurus; identical to SEQ ID NO: 72650

SEQ ID NO: 113857 - DNA, 201 bp, Bos taurus; identical to SEQ ID NO: 72651

SEQ ID NO: 113858 - DNA, 201 bp, Bos taurus; identical to SEQ ID NO: 72652

SEQ ID NO: 113859 - DNA, 201 bp, Bos taurus
tggaaatgggcctcatctcctgtttttctactgcactcagactcatgtcggctgtcagcggggatcttcccctccatgtgacaccagggtgatggggagcrgctgtttacaactgtctagtgctgttctgggtgggtgcaaatgcagaactgagccccacagctcccggaaaatgaaccctgtgtatgccaacctcattta

SEQ ID NO: 113860 - DNA, 201 bp, Bos taurus; identical to SEQ ID NO: 32901

SEQ ID NO: 113861 - DNA, 201 bp, Bos taurus; identical to SEQ ID NO: 32902

SEQ ID NO: 113862 - DNA, 201 bp, Bos taurus
acgcagtgggtggcctgctgacaaaagccctgttctgaagacaagcagagccagaggggaggaagggaggggctgggccctgggttgtgcggggggctggygctgggaatggcacctcattactaagcaccatgttcagggaaagcttctctgggagagtgacaggagaccaaacacccaaggaggtgacagaggcccccg

SEQ ID NO: 113863 - DNA, 201 bp, Bos taurus; identical to SEQ ID NO: 32903

SEQ ID NO: 113864 - DNA, 201 bp, Bos taurus; identical to SEQ ID NO: 32905

SEQ ID NO: 113865 - DNA, 201 bp, Bos taurus
taagggttccaaataatatggtcgaaaaagataaatttggttttctaaaaactcagtgacaaaaaagaagattaaagcagcagaacctttgattgggtttytgtctttgtcggtctttttatttttcagaagtgcctttaatgtttggcttcgtcgggttttttttaaatacttacatgtgttagtcattcagtcgtgtcc

SEQ ID NO: 113866 - DNA, 201 bp, Bos taurus
ctggccgcaggttcttcttccgtagtggcaacatcgagcacccagaggacaagctgttcaacacgtctgtggaggtgttgccctttgatgtgagtgtggtrgggggtgggtgtgcactgaggcctgcccctcccacagccaccggcttcagccccttgattttgcccccagaacccccagtcagacaaggaggccctgcag

SEQ ID NO: 113867 - DNA, 201 bp, Bos taurus
ggtcagaacgctggtgggaggtggactcgggcactgaaaaagaggccttgcatacagatgggctgacctgtctgattgtgttaagagtacttgttacactyctgtaacctgaatactcaaggccattaaccggtggagggaagttaggggggtgtgtgttgtgtgtaggggacagctcagcttgtcctttattcagctggg

SEQ ID NO: 113868 - DNA, 201 bp, Bos taurus; identical to SEQ ID NO: 32907

SEQ ID NO: 113869 - DNA, 201 bp, Bos taurus; identical to SEQ ID NO: 32909

SEQ ID NO: 113870 - DNA, 201 bp, Bos taurus; identical to SEQ ID NO: 32914

SEQ ID NO: 113871 - DNA, 201 bp, Bos taurus
aaaggataaggctcaattctaattttttctcctttcttcactggcaacatattaaactgttattcttggtgtacagctttcaggacaatgtgaaaacctcmcatttaattctttgtcctttcctccattttatgggaggggtttcaaatttatctcccaagttaaaaaaataaaggactattcttccactttatcatgtag

SEQ ID NO: 113872 - DNA, 201 bp, Bos taurus; identical to SEQ ID NO: 72735

SEQ ID NO: 113873 - DNA, 201 bp, Bos taurus
gaagccactcttgggatggctcagaagcaacacctaggctcctgtaaatcaatctggactgaaagggaaagaagtgaaagtgacagggaagaaggctgaaraggaagatgccttacaatcctattggggaggcggtggccaggggacaatggtctctgttttccttcaatcactacgtgcctgacacggcacatggaaatt

SEQ ID NO: 113874 - DNA, 201 bp, Bos taurus
cgcagcgcgtttctgtgcgaatctgagcaaggctgggcttgtgggaaatcgaataccagagacatgatttgggtgcgtataggggctcagtaggctgtgtkttggtttgcagcagggaatgtctgacattttctcttgaatctcgcccccaaggtcatggagttttaatcccactcatcttttaagaatttgttattaccg

SEQ ID NO: 113875 - DNA, 201 bp, Bos taurus
cttgggaacatgcagagattctgacactgcctattctgaatgagtggtggctttgaggagattaaccaatgtgttccagtcagatgaagagtctgtccctrgtcagacccacatcatgcacaacagggcttgcttaggatggtccctctggtccttctgcctctctcctggccaatcacacctgacttgagggtggcagga

SEQ ID NO: 113876 - DNA, 201 bp, Bos taurus
tatattgcaatataattacaaccataacactaattaacacctcttaattaacactacttattaatatcacataatcagcattgcttatttgtagaaggaamaattaagatctaatctcttagcaactttaggtttataatacagaactggtgaccataatcattatactgtgcaatagatctctaggacttatttatctac

SEQ ID NO: 113877 - DNA, 201 bp, Bos taurus; identical to SEQ ID NO: 32920

SEQ ID NO: 113878 - DNA, 201 bp, Bos taurus; identical to SEQ ID NO: 32922

SEQ ID NO: 113879 - DNA, 201 bp, Bos taurus
attgcatgatcagtacctaatgtggcctataacaattaaaaatggcctgtcctggaacagacgcacaggcaacctgacatgaaaccacacaccaagacagrcacccagggaacagcagaaatttagggtagatgcagggaggaagctgctggcccatgccaccatggcccctgcccgttcatggtgagaagcagcagagct

SEQ ID NO: 113880 - DNA, 201 bp, Bos taurus
tcttaccttttcgggagatggatccccatcctgtagcccagcaagaaaggttccaaagagtcaagtctgggggtgcaatacagatgggaagcacagagtcrgaaaaaacaatgcgggttttcagctgcaccagagcgatgtcacctccaacaggatgatacaattcatatgtggggtgtatgatcaccctattcacctcaa

SEQ ID NO: 113881 - DNA, 201 bp, Bos taurus; identical to SEQ ID NO: 32923

SEQ ID NO: 113882 - DNA, 201 bp, Bos taurus; identical to SEQ ID NO: 32924

SEQ ID NO: 113883 - DNA, 201 bp, Bos taurus
gctcggtgtgcctttcctgccactctccagagggtctactcacctggtaggatccacttggttccagccgtcacgcttaccacctaggccgcctgagggtrgcaggagagctcaccagctgacctgcttgtccccttcccttggcactgcttctaggagcatctcaacagctgtccccctcgcggcctccccatgtccaga

SEQ ID NO: 113884 - DNA, 201 bp, Bos taurus
tgggcccatcaaatgtcttctcatgtagagcctttgtgtggtcagcgtctattcagcagacactcaggctggactccactgacagctctcttctccggccrgatgtgtctgtcagggatcagtttctgtctgtgccagttctctcttttctgacctaagggttggagaaagagcatcacacccctctggggccttgagtgg

SEQ ID NO: 113885 - DNA, 201 bp, Bos taurus; identical to SEQ ID NO: 32932

SEQ ID NO: 113886 - DNA, 201 bp, Bos taurus; identical to SEQ ID NO: 32933

SEQ ID NO: 113887 - DNA, 201 bp, Bos taurus; identical to SEQ ID NO: 32936

SEQ ID NO: 113888 - DNA, 201 bp, Bos taurus; identical to SEQ ID NO: 32937

SEQ ID NO: 113889 - DNA, 201 bp, Bos taurus; identical to SEQ ID NO: 32938

SEQ ID NO: 113890 - DNA, 201 bp, Bos taurus
gagcaaccagtatatatcatctcacggtttctctgggtcagggatatgcctcttcctcaaagtctcacacaggccacaatcaagatgttggccagacctgyggtttcatgtgaaagctcaactgtgggaggagctacttcccaattcactcatgtggttgttggctggttgatggctccttgctggccattaactgggggt

SEQ ID NO: 113891 - DNA, 201 bp, Bos taurus
ggccccaagggctgccacacaccagctgggcctcacaccagcgacacagccctgggcatgacacgccccccaccacggcggtttcctcatctgtaacacarggggtgaggactgggcccacttccctgagttgcagaggggactattttacaagatcattttggaaaaacacattagacatgatgccagtattctagggca

SEQ ID NO: 113892 - DNA, 201 bp, Bos taurus; identical to SEQ ID NO: 32940

SEQ ID NO: 113893 - DNA, 201 bp, Bos taurus
agggctgacccacaaagacttgagggtgtaggtggtccaggcttgctttccgagttcacctcccttctcaaaacacagggcctgcttgggcagcattcccrgagcagaagacagtccctggagaggaggagaaccaactgaggttgatgctaaagttgagataaggctcagtggccattgcatctgaatagtgtagccata

SEQ ID NO: 113894 - DNA, 201 bp, Bos taurus
ccatgagtgaagaatctgttccaggcctccctcctaggctggtaactgcacatctctcttcatctttattttgtcttcccttcactcccatctgtttccarattttcctttcttatgacacaagtcctattggactgggaccgatgctttgtcattgtttagtcactcagttgtgtcctaccctttgtaaccccatggact

SEQ ID NO: 113895 - DNA, 201 bp, Bos taurus
atcttcccggaccaggggctgaacctgtgtcccccgcactggcaggcagactctcaacccctggaccaccagaaaaggcccagtaccttttttttgtcagygtgtggctgacacagtttttgagtgtcgtgccctgaacccattttcccaaaagccctgtggccggcgtatgtacagagtgcggtcaccctggtgacgtca

SEQ ID NO: 113896 - DNA, 201 bp, Bos taurus
cttacagagactgtgaggctagcatcatgcctggtgtgattaattgctattttcatttatttatttttatttggttgtgccaggccttagtcccagcacargaaatcactgagcctcattgcggcatgcaggattttcagtgggagcacctgaactcttgcttgcggcacgtggaatccagtttcctgacgagggatcgaa

SEQ ID NO: 113897 - DNA, 201 bp, Bos taurus
tggaaatcccatgtctaccacttcctgacatttttaaaaggctttttttcttgcaacagaatggtggtgatcttaatgaatgtagctttatgttgttgaakaagaaagcacgacaacctctgcataattcaggaaactgatattttccaagggaccaatgctaccatgttcataggaggtccattcggacaaacccaaaat

SEQ ID NO: 113898 - DNA, 201 bp, Bos taurus
ctcatttgtatgtggtgtgactcagttgttccttccccatctgttgttagtttttcaaataaccattttatcttggaaagagttaggtttatagaaatgtygcaaagataatacagagaattcccttatgctattcattgacagcacaagggttaggggagttgaccgtcctcgaagttgaagatccaagtgtaactttac

SEQ ID NO: 113899 - DNA, 201 bp, Bos taurus; identical to SEQ ID NO: 32948

SEQ ID NO: 113900 - DNA, 201 bp, Bos taurus; identical to SEQ ID NO: 32949

SEQ ID NO: 113901 - DNA, 201 bp, Bos taurus; identical to SEQ ID NO: 32950

SEQ ID NO: 113902 - DNA, 201 bp, Bos taurus; identical to SEQ ID NO: 32951

SEQ ID NO: 113903 - DNA, 201 bp, Bos taurus; identical to SEQ ID NO: 32952

SEQ ID NO: 113904 - DNA, 201 bp, Bos taurus; identical to SEQ ID NO: 32953

SEQ ID NO: 113905 - DNA, 201 bp, Bos taurus
gccttaaacagggaagaaattctgaactatgtgacagcatggaaaaacctcgaggacatgatgctgagtgagataggccagcctcaaaaggacatatgtgrtgtggctccactcacacgaggtccctaaagtagtcagattcatagagatagaaggtagagagaagggtgccagggcctggggttggagctggggcgtttg

SEQ ID NO: 113906 - DNA, 201 bp, Bos taurus; identical to SEQ ID NO: 32954

SEQ ID NO: 113907 - DNA, 201 bp, Bos taurus; identical to SEQ ID NO: 32955

SEQ ID NO: 113908 - DNA, 201 bp, Bos taurus
aggaaaatgggccccacggtggcaagtgtgtgaacaatagttttgggggctgaatgcatctctgagcttggagcacaggtcaggtctgagaagaccactgygggcctctttccatcagagccaggctgcccacggagatgggcagggctggggagcagcttggagccctgggacaagttagctagcgccctttgctaactg

SEQ ID NO: 113909 - DNA, 201 bp, Bos taurus
caaccaccacaacatatgtttacatataatgaatttaaatataataatgcattatatatttacatataaatatcatgtgtagttacatgattataggcagytataaaaaccgggacattgacactgacactaataattaactaaagaccttatttggaatccaccaattttaatattcacgcaactgctgtgaaatgcact

SEQ ID NO: 113910 - DNA, 201 bp, Bos taurus; identical to SEQ ID NO: 32956

SEQ ID NO: 113911 - DNA, 201 bp, Bos taurus; identical to SEQ ID NO: 32962

SEQ ID NO: 113912 - DNA, 201 bp, Bos taurus; identical to SEQ ID NO: 32963

SEQ ID NO: 113913 - DNA, 201 bp, Bos taurus; identical to SEQ ID NO: 32965

SEQ ID NO: 113914 - DNA, 201 bp, Bos taurus
gatgtaagtggagttggaatgttgccaaaccaaggaagttttaattcatcacattgtctgaaggggccattcaggcttatataattttcccctaaggcccrtgtgtccattcttctgtctctctctgtctctctcagactttttaaagtatttctttaaatacagggtagaaagtggccataccaagaaggaaccccatgt

SEQ ID NO: 113915 - DNA, 201 bp, Bos taurus
ttaaagatgttcagtgtgtggagtgacatgagcaggagggagaatgaggagatatggcgtcagaggatactgaaaaacaagttggcctccctgttgctgcygaaacttcaagtcacagggttctctaatccacacaaattgttgcaaagatgtcctgtatgtgtaaatgaatctcttctgttgattgagctctggcctctg

SEQ ID NO: 113916 - DNA, 201 bp, Bos taurus
acagacaaacaaacccaaccctccagggattcccatggctttgagaatcaactcgagtccctttccatggcctgcggggcccctgcttgcctccccaagcyctctctctctgttccagtcacactggcttcctgccttaggaggctcagtgggtgcaggcccactgcctcaggtgctcttctaccagcagtccgtcctttg

SEQ ID NO: 113917 - DNA, 201 bp, Bos taurus; identical to SEQ ID NO: 32968

SEQ ID NO: 113918 - DNA, 201 bp, Bos taurus; identical to SEQ ID NO: 72745

SEQ ID NO: 113919 - DNA, 201 bp, Bos taurus; identical to SEQ ID NO: 72747

SEQ ID NO: 113920 - DNA, 201 bp, Bos taurus; identical to SEQ ID NO: 72748

SEQ ID NO: 113921 - DNA, 201 bp, Bos taurus; identical to SEQ ID NO: 32971

SEQ ID NO: 113922 - DNA, 201 bp, Bos taurus; identical to SEQ ID NO: 72753

SEQ ID NO: 113923 - DNA, 201 bp, Bos taurus; identical to SEQ ID NO: 32977

SEQ ID NO: 113924 - DNA, 201 bp, Bos taurus; identical to SEQ ID NO: 72759

SEQ ID NO: 113925 - DNA, 201 bp, Bos taurus; identical to SEQ ID NO: 32978

SEQ ID NO: 113926 - DNA, 201 bp, Bos taurus; identical to SEQ ID NO: 32979

SEQ ID NO: 113927 - DNA, 201 bp, Bos taurus; identical to SEQ ID NO: 32980

SEQ ID NO: 113928 - DNA, 201 bp, Bos taurus; identical to SEQ ID NO: 32981

SEQ ID NO: 113929 - DNA, 201 bp, Bos taurus; identical to SEQ ID NO: 32982

SEQ ID NO: 113930 - DNA, 201 bp, Bos taurus; identical to SEQ ID NO: 32984

SEQ ID NO: 113931 - DNA, 201 bp, Bos taurus; identical to SEQ ID NO: 32985

SEQ ID NO: 113932 - DNA, 201 bp, Bos taurus; identical to SEQ ID NO: 32986

SEQ ID NO: 113933 - DNA, 201 bp, Bos taurus; identical to SEQ ID NO: 32987

SEQ ID NO: 113934 - DNA, 201 bp, Bos taurus; identical to SEQ ID NO: 72764

SEQ ID NO: 113935 - DNA, 201 bp, Bos taurus; identical to SEQ ID NO: 72765

SEQ ID NO: 113936 - DNA, 201 bp, Bos taurus
gcccagagcccattttacagatgggaaaggggaggctggggtcactgggcttgggtcccaagctcctggcgagacctggatgccctgccttatccgtcaayagcggcagcctaaaaggcaaggccgtggtggtgaacctctctgggctcacagggggtcccctggggaaaggcgtggttgtcactcaggtaagatgagggg

SEQ ID NO: 113937 - DNA, 201 bp, Bos taurus; identical to SEQ ID NO: 32993

SEQ ID NO: 113938 - DNA, 201 bp, Bos taurus; identical to SEQ ID NO: 72769

SEQ ID NO: 113939 - DNA, 201 bp, Bos taurus; identical to SEQ ID NO: 32994

SEQ ID NO: 113940 - DNA, 201 bp, Bos taurus; identical to SEQ ID NO: 72770

SEQ ID NO: 113941 - DNA, 201 bp, Bos taurus; identical to SEQ ID NO: 32996

SEQ ID NO: 113942 - DNA, 201 bp, Bos taurus
cgcaggtgccccagaaatcaaggggatgctggtgcctcagaggaggggaggcaagatggggtcagaatcagggaaagaggttgaagtacctgggctccggrggcccgtcccagcgctccgcgttggccccaactggggagtaacctccgggagagcggttccccggataccccccgttctctctgccaggggccctcgccc

SEQ ID NO: 113943 - DNA, 201 bp, Bos taurus; identical to SEQ ID NO: 32998

SEQ ID NO: 113944 - DNA, 201 bp, Bos taurus; identical to SEQ ID NO: 33000

SEQ ID NO: 113945 - DNA, 201 bp, Bos taurus; identical to SEQ ID NO: 33001

SEQ ID NO: 113946 - DNA, 201 bp, Bos taurus; identical to SEQ ID NO: 33002

SEQ ID NO: 113947 - DNA, 201 bp, Bos taurus; identical to SEQ ID NO: 33004

SEQ ID NO: 113948 - DNA, 201 bp, Bos taurus; identical to SEQ ID NO: 33005

SEQ ID NO: 113949 - DNA, 201 bp, Bos taurus
cagcagcagcagcagccttataatggtccgcctctggcctcactgctccctcatccctccaaagctccagtcatcctaaactaacccaagtcacctgtaaygggcactgttggtggccttgtccagccacctttagctgctggagcacccatcccccagtttcggtttctgtgggtgttgcctgctaacagctcacagctt

SEQ ID NO: 113950 - DNA, 201 bp, Bos taurus; identical to SEQ ID NO: 33006

SEQ ID NO: 113951 - DNA, 201 bp, Bos taurus; identical to SEQ ID NO: 33007

SEQ ID NO: 113952 - DNA, 201 bp, Bos taurus
ctggcctcgggacacttggcccatggggctgccctacgtggagatgggtgatgaccacaagagctgctgaggtccagcagggcttcttgatcacccgacayctatgcacccacccaggacagcggcctgaattgggagaccaagagacacagttctgccctccggctccctctccccttcatcctggtcctccgtgccccc

SEQ ID NO: 113953 - DNA, 201 bp, Bos taurus
tttttatcacatgccctgctccatgcattctcagtttgcttccgcctcctctcgcagttgcatcccagtgcctaaaacagctcctggccaggcacacagcrgtgtattcagtcagtaaagacttattgcccaaccctcaatattcactgaaaggacttatgctaaagctgaagctccagtacttaggccacctgatgcgaa

SEQ ID NO: 113954 - DNA, 201 bp, Bos taurus; identical to SEQ ID NO: 33012

SEQ ID NO: 113955 - DNA, 201 bp, Bos taurus
agggagcttccagaggccacaagcagagagcacatttattctagtgcagatagaggccctgccccgtaagtgtccccctgctgctctgggccccgccatcyttctgtccaatgttcccagtcacgtgaggcatgtggtgcgtcagttcacctcagcattcagggtggacgtcctgtgtatccgtgggcaggccagctccag

SEQ ID NO: 113956 - DNA, 201 bp, Bos taurus; identical to SEQ ID NO: 72783

SEQ ID NO: 113957 - DNA, 201 bp, Bos taurus
ctggggaccagtgccaggcaaggagcctgggttcttctggagggtggaggagactacagcagggcgggcgacacagggtggtgtggccctgtttccatttygaaaagctccctcgggctgctgtgatgtaacccaagggctctgtaacttcagcactgttgacatcagggccgttctgggcactgtgaggggtggagcagc

SEQ ID NO: 113958 - DNA, 201 bp, Bos taurus; identical to SEQ ID NO: 33019

SEQ ID NO: 113959 - DNA, 201 bp, Bos taurus; identical to SEQ ID NO: 33020

SEQ ID NO: 113960 - DNA, 201 bp, Bos taurus
cattctgtgttttatgtggtaaccttagcctggacgagcctggggaggcaggcaggaaggcttccaggaggaagaggcagtggtgctaagagcccatggtkcggccacctttccttcccctcccccacccagcgtgccctcttggctgtgctcacaagagactggaggtggagacgatccccatgccagggttgaagatgt

SEQ ID NO: 113961 - DNA, 201 bp, Bos taurus; identical to SEQ ID NO: 72791

SEQ ID NO: 113962 - DNA, 201 bp, Bos taurus; identical to SEQ ID NO: 33022

SEQ ID NO: 113963 - DNA, 201 bp, Bos taurus
aaccccagggtgctctgagccagctgtgaccacagagctggcagccatgctccaggacagggcagaactaggagaaacgaggagccttggatccctgaaaygactgcatggaacagggctgcccgggagtccagctcaggactgttaagtgcctgagaaatcaacatgtgcctgaggtctctaaatccagcgagtctcctt

SEQ ID NO: 113964 - DNA, 201 bp, Bos taurus
gggctttggcgtgctgcctgcggagctggtcaaactcagcctggagagcgtcatagagctccagaggaatgacctcggccggaccatctgcctccatctcrtccttctcgaagtgctccaggatctggtggggacaggggaaccgagcaagagtggaagtggccgtggtgggcgtgggggggcacagggcagccacaccac

SEQ ID NO: 113965 - DNA, 201 bp, Bos taurus; identical to SEQ ID NO: 33023

SEQ ID NO: 113966 - DNA, 201 bp, Bos taurus; identical to SEQ ID NO: 33024

SEQ ID NO: 113967 - DNA, 201 bp, Bos taurus
tgtcgtcccagggtggggactgtgacggcttctcgactttcgacgtccccatcttcactgaagagttcttggaccaaaacaaaggtgagcgctgaccagcrgttcttgaagcaagcgttgaaccaagagggcatcgaggcgggaggcagtgggtgccttcctctcttgccctcgcagcccagactgctgagatgtggggct

SEQ ID NO: 113968 - DNA, 201 bp, Bos taurus
ccacaatccacaggatggccccacggagaacagtctggccctcaatgtccacagtgctaaagtacgtcctacctcagactagtggtttttcacccgtgctrtccagaaggggtgaagggtgtgaacccccaagaaatcacatgcaaggtttggtgtgggtgtccatatttgtgggtgaggaaagggtattttggagtttgg

SEQ ID NO: 113969 - DNA, 201 bp, Bos taurus; identical to SEQ ID NO: 33029

SEQ ID NO: 113970 - DNA, 201 bp, Bos taurus
tgtgtgtgtgcgcgcgcgcgagtgcaagtgtgagagatctgtcgaagcgttcacttcccttatgtatgagatggatcaataatagttctcacctcctataytatgaggaataaattaagaaatgtgaggtgtttacacacgggaggcggcccagtgactccactcctgggtctatccaagagaaatgattacttggctcca

SEQ ID NO: 113971 - DNA, 201 bp, Bos taurus
ggccaggaggcagctagagctgggcagccatccgttgagcctggtcggcacctggacagcatgcagtcactgcgtccagagcactgacagcagggcttttyataactgggagctggcccggatccaagtgcccgggtcagacagctcggggaggcgagggaggtcagagcacccgaggacagcaccctgctgccccacctc

SEQ ID NO: 113972 - DNA, 201 bp, Bos taurus; identical to SEQ ID NO: 33033

SEQ ID NO: 113973 - DNA, 201 bp, Bos taurus
acaaagccgtgggagtgtcatgtggctgttcttgctggtgtttcagcctgccttctcgctgtggccagggcgtgatgtgctcatcagtaacggagcagatrgactctagggcacggatgaagctagcacacagccaagttgggaggaggaggcagaactctggactgcttctctggacctgtgtcctcaggatttccaggg

SEQ ID NO: 113974 - DNA, 201 bp, Bos taurus
tggtccctctgcctgaaaagttcctccccaacgtggtcagagagtttctatcctcattccgttcagtctgaccaagccccatcttagacacctcatcataytggcctttcaaaacttccttgaacatctgcatcctcattcccgccccctgctctgctttcttcctagcacacaccgccactgtaacatgacattcttatt

SEQ ID NO: 113975 - DNA, 201 bp, Bos taurus
tctgaccccagtctccccttctcctcctagagctcacagttctggccacagtgggagattggagtgtgagaaagactctcacaggcctgcctcactgcccrcctaggcagattccagaccaatgacatggtcctgtgacagctcacctcagctcctaccaaggatctagagcggtcagcaagctgtgcccatccagggccc

SEQ ID NO: 113976 - DNA, 201 bp, Bos taurus; identical to SEQ ID NO: 33044

SEQ ID NO: 113977 - DNA, 201 bp, Bos taurus; identical to SEQ ID NO: 33045

SEQ ID NO: 113978 - DNA, 201 bp, Bos taurus; identical to SEQ ID NO: 33046

SEQ ID NO: 113979 - DNA, 201 bp, Bos taurus
gtcagtgttctgcatatgttctcagtccatagctgaaaggggccagaaccatttcatagtctcctctagattccccactccaaatcttcctgcctgttacycagtacgctggtgggtaagactcctctctggtcccttggtccatgtttctgggtcccactgttcatggataggggctgagtttttgttgttgggataggg

SEQ ID NO: 113980 - DNA, 201 bp, Bos taurus; identical to SEQ ID NO: 33050

SEQ ID NO: 113981 - DNA, 201 bp, Bos taurus; identical to SEQ ID NO: 33051

SEQ ID NO: 113982 - DNA, 201 bp, Bos taurus; identical to SEQ ID NO: 33052

SEQ ID NO: 113983 - DNA, 201 bp, Bos taurus; identical to SEQ ID NO: 33056

SEQ ID NO: 113984 - DNA, 201 bp, Bos taurus
tctttaagtatattcaaagtgtcttctcagttcacagcagaattaaatcagaaagcaataacagaaagatctctggaacatacccaaacattcagaagctrtgtaaacccatttctagtatccatggattgaagaagaaattaaaggggaaactagaaagcattttgaattgaacaaaaatgaaaacagtatcaaatttta

SEQ ID NO: 113985 - DNA, 201 bp, Bos taurus; identical to SEQ ID NO: 33064

SEQ ID NO: 113986 - DNA, 201 bp, Bos taurus
ttgggcctccatgctgcaactactgaagcccgagtgccctaggattcgagctctgcaacaagagaagcttgtttatagctgtggaaatatacctgggtcartgaggggcctgtgaggataagtgggataattgatgcttgtgtaatgcataaaaattattggagaaaaaaattgttcatatgcatttattcttttcctctc

SEQ ID NO: 113987 - DNA, 201 bp, Bos taurus; identical to SEQ ID NO: 33065

SEQ ID NO: 113988 - DNA, 201 bp, Bos taurus; identical to SEQ ID NO: 33066

SEQ ID NO: 113989 - DNA, 201 bp, Bos taurus; identical to SEQ ID NO: 33069

SEQ ID NO: 113990 - DNA, 201 bp, Bos taurus; identical to SEQ ID NO: 33071

SEQ ID NO: 113991 - DNA, 201 bp, Bos taurus
tcccagttctgatcccaaaaataacttctataaatgttcactgaccaaatagcggctgtaaaggaaaaagactggaatgtcaaaatgtgtcatgttcgaakaaagatacatgttgtctcttaagaactacttccaacgacactcttaaactggacaaattctgccaatccaggacacatgctatccctcaaatttgctcga

SEQ ID NO: 113992 - DNA, 201 bp, Bos taurus; identical to SEQ ID NO: 33073

SEQ ID NO: 113993 - DNA, 201 bp, Bos taurus
taattccagctacctttacaacccctctgttttaatttctacctcctcagctcagtgagactgatgtttttcacctgggcttcacaaccgtgtgccacatkcaaggaaggtcccatagacataaaacaaggttgaatgtgtgcttatctcatgacgtctggacttttcaggactctagtcctgcactgcctattatccaat

SEQ ID NO: 113994 - DNA, 201 bp, Bos taurus
tccgtgcctggcagctagccagcagggggtcagtgccaccttcaaggcagctgtacaacctgtgcttgaacagtcagtcttctctcctccaaagagaaggygacattccagatcctgtcctctggccccgagtctgcactcttctctcatggtatttcatttcttcctgacctagtccccagctggtctccatacatacca

SEQ ID NO: 113995 - DNA, 201 bp, Bos taurus; identical to SEQ ID NO: 33075

SEQ ID NO: 113996 - DNA, 201 bp, Bos taurus
ttgacaaagtgcctatcggtatgaaatttgatctaatgataaacaagattatcatacacatgcctgagtcctgaattcagagacaggtaacatgagttggrtgtaaggttccacactcatgtctaataaggaataaaaactatttcaaacaaagacctgtatatggaaaggtccactaaatggaagataggtaacctgagt

SEQ ID NO: 113997 - DNA, 201 bp, Bos taurus; identical to SEQ ID NO: 33076

SEQ ID NO: 113998 - DNA, 201 bp, Bos taurus
ggaaattatttaatcagttctagtagctccctttccagtttatttacttatcaatttttttaagaattataatcatgcatcacatcagaagggtatgattkgtgagctagctgttagctatcactttatacagatcatccactaggctggactaaactttgcatcttgaagatttcaagcaatttccaaatgtctgactta

SEQ ID NO: 113999 - DNA, 201 bp, Bos taurus
cttcattcccgatcctcactccctttctcctcggggcgcaaatgagcgccacaggctggttgtgggccgacgtccccacgttctacatgttcgggaaaatktgcccttcgaggagaacccagcgacgcccagtggggaattccgtaggtttagaaaacaaggagaggagcacgggaggcgggaaagagacaaccgcacgcc

SEQ ID NO: 114000 - DNA, 201 bp, Bos taurus; identical to SEQ ID NO: 33079

SEQ ID NO: 114001 - DNA, 201 bp, Bos taurus
gagttccagggcttgctgatagatacgtggtgattaacaattctcattgtgcccgtgtgccttgtgccctctctttgttgttctgcagttgggtatcaaarctgtgctatctatgttctttgaagactaagcaggttggacgtgcgattcagatgaaaaacaattactctgtgttagcttgcttttggcaagagtgtatta

SEQ ID NO: 114002 - DNA, 201 bp, Bos taurus; identical to SEQ ID NO: 33080

SEQ ID NO: 114003 - DNA, 201 bp, Bos taurus; identical to SEQ ID NO: 33081

SEQ ID NO: 114004 - DNA, 201 bp, Bos taurus; identical to SEQ ID NO: 33082

SEQ ID NO: 114005 - DNA, 201 bp, Bos taurus
ctttacagaaatttctcagtaactgtcttactatcttaaaagtaaatacagcaattactgtatcatttttataaaagagaaaagtgagcaacaggccaggyagctgttaagtgatgtgtccccaaatagaacatagctctagaaagaaagtgacttatgttattcacacttctatctccagcaccaagggccatgtctaac

SEQ ID NO: 114006 - DNA, 201 bp, Bos taurus
ctgggagatagtggaggacagggaagcctggcatgctgcagtccacggggtcacaaagagtcagatgcaacttatcaactgaacaactataaccgtacacrgtgtaaacagcaaagcctacatatagtatgaaaaagtatgagttttagcaaaaaagatctgattttaaactgtagtactgctacatactagcagtgtgtc

SEQ ID NO: 114007 - DNA, 201 bp, Bos taurus
gtgaatgtggcccgtaaatttggcatgcttagtctttataggctgggtaattatatatgctaatgagtaggaggattattccaactatttttgggaaaggrcggaggcttccaggatatgggccaccacccactccttggtcttttaacaatgccctggaactgtcatggcacctctgggtgtgtcatttcacttgctgat

SEQ ID NO: 114008 - DNA, 201 bp, Bos taurus; identical to SEQ ID NO: 33087

SEQ ID NO: 114009 - DNA, 201 bp, Bos taurus
tctacctacagtactgcctatcttttgtagtgtggcttctgataaataggcccccagaagagacaatttggggagctggaaagtactttatttttctttawaacctgacatagcattgtccaggccttgcaggtgggaggaacatcggaagcagaaaggcaggaggagacctaacggtaatagtgactgacaaatcaaaag

SEQ ID NO: 114010 - DNA, 201 bp, Bos taurus; identical to SEQ ID NO: 33088

SEQ ID NO: 114011 - DNA, 201 bp, Bos taurus; identical to SEQ ID NO: 33089

SEQ ID NO: 114012 - DNA, 201 bp, Bos taurus; identical to SEQ ID NO: 33090

SEQ ID NO: 114013 - DNA, 201 bp, Bos taurus; identical to SEQ ID NO: 72833

SEQ ID NO: 114014 - DNA, 201 bp, Bos taurus; identical to SEQ ID NO: 33093

SEQ ID NO: 114015 - DNA, 201 bp, Bos taurus; identical to SEQ ID NO: 72837

SEQ ID NO: 114016 - DNA, 201 bp, Bos taurus; identical to SEQ ID NO: 33094

SEQ ID NO: 114017 - DNA, 201 bp, Bos taurus; identical to SEQ ID NO: 72841

SEQ ID NO: 114018 - DNA, 201 bp, Bos taurus
aagcggggaactgcggcggccgcggcggcagcagtccgggtgtgtgaaaggttttacccaggcggcaaaaggtcctctggcggcgggctcctgtctgcctrcagacaggccgggccgggtggactggcggccccgggccggggagcctggcgcgctgcaggccgaccgccgagcgggatcctggtgtccggggctgtggga

SEQ ID NO: 114019 - DNA, 201 bp, Bos taurus
aatagcttatctaatacttggacagcataacccttttctcgattaacatgttaactagtcaaaagcctgcagacacattggatgagtgctgaattttcctyaatattgcagattaaaacttggccagaacaaataaaatattaccacaagaatcctactttgacattattgtaaatttttgtgaatgccagcccgatagtg

SEQ ID NO: 114020 - DNA, 201 bp, Bos taurus
aaaaagcctatgaacttatttgttctccttgaaacaattcttgcccttttccatccatcaatatactgtgcccaagtatgtgaacactcagaacatcaggrgcaccacctttgctcttacatacggtttgaagaagtatttagataatactcctgagtgacagactatcaaaataaagaagagagaggcctactgaagttt

SEQ ID NO: 114021 - DNA, 201 bp, Bos taurus; identical to SEQ ID NO: 33098

SEQ ID NO: 114022 - DNA, 201 bp, Bos taurus; identical to SEQ ID NO: 33099

SEQ ID NO: 114023 - DNA, 201 bp, Bos taurus; identical to SEQ ID NO: 33100

SEQ ID NO: 114024 - DNA, 201 bp, Bos taurus; identical to SEQ ID NO: 33102

SEQ ID NO: 114025 - DNA, 201 bp, Bos taurus; identical to SEQ ID NO: 33103

SEQ ID NO: 114026 - DNA, 201 bp, Bos taurus; identical to SEQ ID NO: 33104

SEQ ID NO: 114027 - DNA, 201 bp, Bos taurus; identical to SEQ ID NO: 72854

SEQ ID NO: 114028 - DNA, 201 bp, Bos taurus
ggccttttgcaggaaacatcctgtgtttcccagtagcacacttctctcacatcactgaaggtatatgctctggggattccctccttgagagctgtgtgaaycgtttagttgcctgttgccaggccctgccttctgcagaggctgctggtcactaactggcaggactggatgacaaggtgactggctgtggaaactcctggc

SEQ ID NO: 114029 - DNA, 201 bp, Bos taurus
ctcctatgctctgaaatacactttgttcttttaatagaatttgcttcacttgatataatttaaccttacaaaatcttttaaattgagcatagattttaaartaattttctgaagtaactgctcccatgaaaaaatgtggcagggaaaggaacaaagtctgttgtgaagatttgtggcacgtttctttcatagagtgaatta

SEQ ID NO: 114030 - DNA, 201 bp, Bos taurus
ataattaatttagcaaatatactgagtgtgtgctatatatcaagcactattcttagaagataattaaatagtgatcaagactaagttggtcaaagaaaccrggaggcattctacttgagttaataacacaaaggaagtgactgacagttgaagaatacaaagaaggctcctatccttgagaaacttgaagcctagatggcc

SEQ ID NO: 114031 - DNA, 201 bp, Bos taurus
gtttgattttaccttatcaagagtaaatctgagcattcttttcatgtgtttaaagactattgtcatttctacaaaaaacccagaaactgggcagaagaccwaaacagacatttctccaaagaggacatacagatggccaataaacgcatgaaatgatgctcaacattaatcattattaagttcagttcaattgctcagttg

SEQ ID NO: 114032 - DNA, 201 bp, Bos taurus
gatcacaaagagtcagacactaatgagtgagagacactttcactttcaaatacacacacaaaatggagtattattcaaccataaaataacaaaattttgcratattcaacaacatggatcaatcgacagggtattatgataagtgaaataagtcagacagagaaagacaaatactctatgttatcacttatgtatggaatt

SEQ ID NO: 114033 - DNA, 201 bp, Bos taurus
tttcattttatataagaatattcaacccagctgcaccagattcttctctagagcatctacatccacgattgtcccctaataatcagttgtcatctaatcaygaagttctgttcagctccttgaagccccatgaactgtaactaccagcctcctctgtccatggatttccaaggcaagaatactggagtgggttgccatttc

SEQ ID NO: 114034 - DNA, 201 bp, Bos taurus; identical to SEQ ID NO: 72856

SEQ ID NO: 114035 - DNA, 201 bp, Bos taurus; identical to SEQ ID NO: 72857

SEQ ID NO: 114036 - DNA, 201 bp, Bos taurus; identical to SEQ ID NO: 33108

SEQ ID NO: 114037 - DNA, 201 bp, Bos taurus; identical to SEQ ID NO: 72858

SEQ ID NO: 114038 - DNA, 201 bp, Bos taurus; identical to SEQ ID NO: 33113

SEQ ID NO: 114039 - DNA, 201 bp, Bos taurus; identical to SEQ ID NO: 72862

SEQ ID NO: 114040 - DNA, 201 bp, Bos taurus; identical to SEQ ID NO: 72863

SEQ ID NO: 114041 - DNA, 201 bp, Bos taurus; identical to SEQ ID NO: 72864

SEQ ID NO: 114042 - DNA, 201 bp, Bos taurus; identical to SEQ ID NO: 33114

SEQ ID NO: 114043 - DNA, 201 bp, Bos taurus; identical to SEQ ID NO: 72866

SEQ ID NO: 114044 - DNA, 201 bp, Bos taurus; identical to SEQ ID NO: 33115

SEQ ID NO: 114045 - DNA, 201 bp, Bos taurus; identical to SEQ ID NO: 72868

SEQ ID NO: 114046 - DNA, 201 bp, Bos taurus; identical to SEQ ID NO: 72869

SEQ ID NO: 114047 - DNA, 201 bp, Bos taurus; identical to SEQ ID NO: 72870

SEQ ID NO: 114048 - DNA, 201 bp, Bos taurus
attatcattaaaggaaaacatatgctaagaccacaggaaaaacgatcacttgtcataaaattttaaaacagagaaagcaaaatgttaagttctagctagayacttcagcacattgaagactctgaacttgacatatgttttaaaataaatgacctaaatgtacacactgctatatttaaaatagataaccaacaaagacct

SEQ ID NO: 114049 - DNA, 201 bp, Bos taurus; identical to SEQ ID NO: 33118

SEQ ID NO: 114050 - DNA, 201 bp, Bos taurus; identical to SEQ ID NO: 72873

SEQ ID NO: 114051 - DNA, 201 bp, Bos taurus; identical to SEQ ID NO: 72874

SEQ ID NO: 114052 - DNA, 201 bp, Bos taurus; identical to SEQ ID NO: 33122

SEQ ID NO: 114053 - DNA, 201 bp, Bos taurus; identical to SEQ ID NO: 33126

SEQ ID NO: 114054 - DNA, 201 bp, Bos taurus; identical to SEQ ID NO: 33129

SEQ ID NO: 114055 - DNA, 201 bp, Bos taurus
aggataggaaaattcaggcctcaatgatttctccttcagagagaaaaaaaatgaggttttgcagagagaaggatgataaaaagaccttgacatttttcaaygcattcctgttttggagttggccctttgtttccagtgttcccttattcttttgatggttgtgcagtctgtactgatatccactgtgtcacccttgatatt

SEQ ID NO: 114056 - DNA, 201 bp, Bos taurus; identical to SEQ ID NO: 33131

SEQ ID NO: 114057 - DNA, 201 bp, Bos taurus
gcatttaatcctttaagtggcatctttacctcctaagaggaaatggcttttttcagctttatgttatccacggggagaacactgaggccatgtaaggtggytctgtgtataaattcattgtgggcagggggtggtaggtgatggggtggactgaacccaagaaatgaaagaaaggaaagtatacaggcccacttgggctaa

SEQ ID NO: 114058 - DNA, 201 bp, Bos taurus; identical to SEQ ID NO: 33132

SEQ ID NO: 114059 - DNA, 201 bp, Bos taurus; identical to SEQ ID NO: 33133

SEQ ID NO: 114060 - DNA, 201 bp, Bos taurus; identical to SEQ ID NO: 33134

SEQ ID NO: 114061 - DNA, 201 bp, Bos taurus; identical to SEQ ID NO: 72884

SEQ ID NO: 114062 - DNA, 201 bp, Bos taurus; identical to SEQ ID NO: 72885

SEQ ID NO: 114063 - DNA, 201 bp, Bos taurus
aaagctacccagtccagtattttggcctgttgaattccatggagtgtataatccatgggtttgcaaacagtcagacacgtctgagtgacttttactttcayaggtgtgaaaattactgtcttattcccagtgttcattttctaagtttttgttaagtaaaaaatgttagtaatctagtgtcttcaagtttcctattttcaa

SEQ ID NO: 114064 - DNA, 201 bp, Bos taurus
gtataagcaaattcaaaggagtcttatttctgtccctggacatctggctccaaagagcaaaggcttaggaacaacaccattcatgacgggcaagcaaaatracaggattagcaggagcccttgggcccacagtatgaaattaaatgagggataatggatctgaagtcttggatgccaacaaagagaacacaaaatgataga

SEQ ID NO: 114065 - DNA, 201 bp, Bos taurus
tagaatcaaaagattagagtggcagagtttgcctgaatttggtatcaaaaatggtaaaaaatagaagatagggggaaaccgtaaatctggctaagagcatrgttgctacagggcagcacctggtgggtgtgattctggtgcccctggaagaccattcaataatgaagaaacagcaaacatttggaggtaggagggaagggt

SEQ ID NO: 114066 - DNA, 201 bp, Bos taurus; identical to SEQ ID NO: 33135

SEQ ID NO: 114067 - DNA, 201 bp, Bos taurus; identical to SEQ ID NO: 33136

SEQ ID NO: 114068 - DNA, 201 bp, Bos taurus; identical to SEQ ID NO: 33137

SEQ ID NO: 114069 - DNA, 201 bp, Bos taurus; identical to SEQ ID NO: 33138

SEQ ID NO: 114070 - DNA, 201 bp, Bos taurus; identical to SEQ ID NO: 33139

SEQ ID NO: 114071 - DNA, 201 bp, Bos taurus; identical to SEQ ID NO: 33140

SEQ ID NO: 114072 - DNA, 201 bp, Bos taurus; identical to SEQ ID NO: 33141

SEQ ID NO: 114073 - DNA, 201 bp, Bos taurus; identical to SEQ ID NO: 33142

SEQ ID NO: 114074 - DNA, 201 bp, Bos taurus; identical to SEQ ID NO: 33143

SEQ ID NO: 114075 - DNA, 201 bp, Bos taurus; identical to SEQ ID NO: 33144

SEQ ID NO: 114076 - DNA, 201 bp, Bos taurus; identical to SEQ ID NO: 33145

SEQ ID NO: 114077 - DNA, 201 bp, Bos taurus; identical to SEQ ID NO: 33146

SEQ ID NO: 114078 - DNA, 201 bp, Bos taurus; identical to SEQ ID NO: 33147

SEQ ID NO: 114079 - DNA, 201 bp, Bos taurus; identical to SEQ ID NO: 33148

SEQ ID NO: 114080 - DNA, 201 bp, Bos taurus; identical to SEQ ID NO: 33149

SEQ ID NO: 114081 - DNA, 201 bp, Bos taurus; identical to SEQ ID NO: 33150

SEQ ID NO: 114082 - DNA, 201 bp, Bos taurus; identical to SEQ ID NO: 33151

SEQ ID NO: 114083 - DNA, 201 bp, Bos taurus; identical to SEQ ID NO: 33152

SEQ ID NO: 114084 - DNA, 201 bp, Bos taurus; identical to SEQ ID NO: 33153

SEQ ID NO: 114085 - DNA, 201 bp, Bos taurus; identical to SEQ ID NO: 33154

SEQ ID NO: 114086 - DNA, 201 bp, Bos taurus; identical to SEQ ID NO: 33155

SEQ ID NO: 114087 - DNA, 201 bp, Bos taurus; identical to SEQ ID NO: 33156

SEQ ID NO: 114088 - DNA, 201 bp, Bos taurus; identical to SEQ ID NO: 33157

SEQ ID NO: 114089 - DNA, 201 bp, Bos taurus; identical to SEQ ID NO: 33158

SEQ ID NO: 114090 - DNA, 201 bp, Bos taurus; identical to SEQ ID NO: 33159

SEQ ID NO: 114091 - DNA, 201 bp, Bos taurus; identical to SEQ ID NO: 33160

SEQ ID NO: 114092 - DNA, 201 bp, Bos taurus; identical to SEQ ID NO: 33161

SEQ ID NO: 114093 - DNA, 201 bp, Bos taurus; identical to SEQ ID NO: 33162

SEQ ID NO: 114094 - DNA, 201 bp, Bos taurus; identical to SEQ ID NO: 33163

SEQ ID NO: 114095 - DNA, 201 bp, Bos taurus; identical to SEQ ID NO: 33164

SEQ ID NO: 114096 - DNA, 201 bp, Bos taurus; identical to SEQ ID NO: 33165

SEQ ID NO: 114097 - DNA, 201 bp, Bos taurus; identical to SEQ ID NO: 33166

SEQ ID NO: 114098 - DNA, 201 bp, Bos taurus; identical to SEQ ID NO: 33167

SEQ ID NO: 114099 - DNA, 201 bp, Bos taurus; identical to SEQ ID NO: 33168

SEQ ID NO: 114100 - DNA, 201 bp, Bos taurus; identical to SEQ ID NO: 33169

SEQ ID NO: 114101 - DNA, 201 bp, Bos taurus; identical to SEQ ID NO: 33170

SEQ ID NO: 114102 - DNA, 201 bp, Bos taurus; identical to SEQ ID NO: 33171

SEQ ID NO: 114103 - DNA, 201 bp, Bos taurus; identical to SEQ ID NO: 33172

SEQ ID NO: 114104 - DNA, 201 bp, Bos taurus; identical to SEQ ID NO: 33173

SEQ ID NO: 114105 - DNA, 201 bp, Bos taurus; identical to SEQ ID NO: 33174

SEQ ID NO: 114106 - DNA, 201 bp, Bos taurus; identical to SEQ ID NO: 33175

SEQ ID NO: 114107 - DNA, 201 bp, Bos taurus; identical to SEQ ID NO: 33176

SEQ ID NO: 114108 - DNA, 201 bp, Bos taurus; identical to SEQ ID NO: 33177

SEQ ID NO: 114109 - DNA, 201 bp, Bos taurus; identical to SEQ ID NO: 33178

SEQ ID NO: 114110 - DNA, 201 bp, Bos taurus; identical to SEQ ID NO: 33179

SEQ ID NO: 114111 - DNA, 201 bp, Bos taurus; identical to SEQ ID NO: 33180

SEQ ID NO: 114112 - DNA, 201 bp, Bos taurus; identical to SEQ ID NO: 33181

SEQ ID NO: 114113 - DNA, 201 bp, Bos taurus; identical to SEQ ID NO: 33182

SEQ ID NO: 114114 - DNA, 201 bp, Bos taurus
gggagggggtggtgtctggagcctacaaccctgccctgcagatgggccacagggcacaatcctgggagccagggctccaggagagatagaaactgcacccygccccccaactcctgactgaaggctggatcgccctactttctttccacactggggggcccccggacgtctgctgttcctaaaaaggtgaggggctggggg

SEQ ID NO: 114115 - DNA, 201 bp, Bos taurus; identical to SEQ ID NO: 33183

SEQ ID NO: 114116 - DNA, 201 bp, Bos taurus; identical to SEQ ID NO: 33184

SEQ ID NO: 114117 - DNA, 201 bp, Bos taurus; identical to SEQ ID NO: 33185

SEQ ID NO: 114118 - DNA, 201 bp, Bos taurus; identical to SEQ ID NO: 33186

SEQ ID NO: 114119 - DNA, 201 bp, Bos taurus; identical to SEQ ID NO: 33187

SEQ ID NO: 114120 - DNA, 201 bp, Bos taurus; identical to SEQ ID NO: 33188

SEQ ID NO: 114121 - DNA, 201 bp, Bos taurus; identical to SEQ ID NO: 33189

SEQ ID NO: 114122 - DNA, 201 bp, Bos taurus; identical to SEQ ID NO: 33190

SEQ ID NO: 114123 - DNA, 201 bp, Bos taurus
tgtggggtttctgtgtagaagaaggtcagtttctgtagagaagttctctagagctgactgtgcattctctggatttccagcaccctagactgttgccaaamttggctcccatgtgcctgggaggaggtgcgggctgagcctgggctggccagtgtacacagatcctggaaagctcagggatcctggaaagttccctgaatg

SEQ ID NO: 114124 - DNA, 201 bp, Bos taurus; identical to SEQ ID NO: 33191

SEQ ID NO: 114125 - DNA, 201 bp, Bos taurus; identical to SEQ ID NO: 33192

SEQ ID NO: 114126 - DNA, 201 bp, Bos taurus
ggctggacaccgctgacccttcctgggttcctcttctaaatacacattctcagggtgggaagtgacagccactcaggcctagccctccctgcaagtgggtkgagcagatgagagccccgaaggaaagactgagcatgggaagggaggctcctggaggccactgcgcaccccaggaggcttctcctcctcgaatcgtcttca

SEQ ID NO: 114127 - DNA, 201 bp, Bos taurus; identical to SEQ ID NO: 33193

SEQ ID NO: 114128 - DNA, 201 bp, Bos taurus; identical to SEQ ID NO: 33194

SEQ ID NO: 114129 - DNA, 201 bp, Bos taurus; identical to SEQ ID NO: 33195

SEQ ID NO: 114130 - DNA, 201 bp, Bos taurus; identical to SEQ ID NO: 33196

SEQ ID NO: 114131 - DNA, 201 bp, Bos taurus; identical to SEQ ID NO: 33197

SEQ ID NO: 114132 - DNA, 201 bp, Bos taurus; identical to SEQ ID NO: 33198

SEQ ID NO: 114133 - DNA, 201 bp, Bos taurus; identical to SEQ ID NO: 33199

SEQ ID NO: 114134 - DNA, 201 bp, Bos taurus; identical to SEQ ID NO: 33200

SEQ ID NO: 114135 - DNA, 201 bp, Bos taurus; identical to SEQ ID NO: 33201

SEQ ID NO: 114136 - DNA, 201 bp, Bos taurus; identical to SEQ ID NO: 33202

SEQ ID NO: 114137 - DNA, 201 bp, Bos taurus; identical to SEQ ID NO: 33203

SEQ ID NO: 114138 - DNA, 201 bp, Bos taurus; identical to SEQ ID NO: 33204

SEQ ID NO: 114139 - DNA, 201 bp, Bos taurus; identical to SEQ ID NO: 33205

SEQ ID NO: 114140 - DNA, 201 bp, Bos taurus; identical to SEQ ID NO: 33206

SEQ ID NO: 114141 - DNA, 201 bp, Bos taurus; identical to SEQ ID NO: 33207

SEQ ID NO: 114142 - DNA, 201 bp, Bos taurus; identical to SEQ ID NO: 33208

SEQ ID NO: 114143 - DNA, 201 bp, Bos taurus; identical to SEQ ID NO: 33209

SEQ ID NO: 114144 - DNA, 201 bp, Bos taurus; identical to SEQ ID NO: 33210

SEQ ID NO: 114145 - DNA, 201 bp, Bos taurus; identical to SEQ ID NO: 33211

SEQ ID NO: 114146 - DNA, 201 bp, Bos taurus; identical to SEQ ID NO: 33212

SEQ ID NO: 114147 - DNA, 201 bp, Bos taurus; identical to SEQ ID NO: 33213

SEQ ID NO: 114148 - DNA, 201 bp, Bos taurus; identical to SEQ ID NO: 33214

SEQ ID NO: 114149 - DNA, 201 bp, Bos taurus; identical to SEQ ID NO: 33215

SEQ ID NO: 114150 - DNA, 201 bp, Bos taurus; identical to SEQ ID NO: 33216

SEQ ID NO: 114151 - DNA, 201 bp, Bos taurus; identical to SEQ ID NO: 33217

SEQ ID NO: 114152 - DNA, 201 bp, Bos taurus; identical to SEQ ID NO: 33218

SEQ ID NO: 114153 - DNA, 201 bp, Bos taurus; identical to SEQ ID NO: 33219

SEQ ID NO: 114154 - DNA, 201 bp, Bos taurus; identical to SEQ ID NO: 33220

SEQ ID NO: 114155 - DNA, 201 bp, Bos taurus; identical to SEQ ID NO: 33221

SEQ ID NO: 114156 - DNA, 201 bp, Bos taurus; identical to SEQ ID NO: 33222

SEQ ID NO: 114157 - DNA, 201 bp, Bos taurus; identical to SEQ ID NO: 33223

SEQ ID NO: 114158 - DNA, 201 bp, Bos taurus; identical to SEQ ID NO: 33224

SEQ ID NO: 114159 - DNA, 201 bp, Bos taurus; identical to SEQ ID NO: 33225

SEQ ID NO: 114160 - DNA, 201 bp, Bos taurus; identical to SEQ ID NO: 33226

SEQ ID NO: 114161 - DNA, 201 bp, Bos taurus; identical to SEQ ID NO: 33227

SEQ ID NO: 114162 - DNA, 201 bp, Bos taurus; identical to SEQ ID NO: 33228

SEQ ID NO: 114163 - DNA, 201 bp, Bos taurus; identical to SEQ ID NO: 33229

SEQ ID NO: 114164 - DNA, 201 bp, Bos taurus; identical to SEQ ID NO: 33230

SEQ ID NO: 114165 - DNA, 201 bp, Bos taurus; identical to SEQ ID NO: 33231

SEQ ID NO: 114166 - DNA, 201 bp, Bos taurus; identical to SEQ ID NO: 33233

SEQ ID NO: 114167 - DNA, 201 bp, Bos taurus; identical to SEQ ID NO: 33234

SEQ ID NO: 114168 - DNA, 201 bp, Bos taurus; identical to SEQ ID NO: 33235

SEQ ID NO: 114169 - DNA, 201 bp, Bos taurus; identical to SEQ ID NO: 33236

SEQ ID NO: 114170 - DNA, 201 bp, Bos taurus; identical to SEQ ID NO: 33237

SEQ ID NO: 114171 - DNA, 201 bp, Bos taurus; identical to SEQ ID NO: 33238

SEQ ID NO: 114172 - DNA, 201 bp, Bos taurus; identical to SEQ ID NO: 33239

SEQ ID NO: 114173 - DNA, 201 bp, Bos taurus; identical to SEQ ID NO: 33240

SEQ ID NO: 114174 - DNA, 201 bp, Bos taurus; identical to SEQ ID NO: 33241

SEQ ID NO: 114175 - DNA, 201 bp, Bos taurus; identical to SEQ ID NO: 33242

SEQ ID NO: 114176 - DNA, 201 bp, Bos taurus; identical to SEQ ID NO: 33243

SEQ ID NO: 114177 - DNA, 201 bp, Bos taurus; identical to SEQ ID NO: 33244

SEQ ID NO: 114178 - DNA, 201 bp, Bos taurus; identical to SEQ ID NO: 33245

SEQ ID NO: 114179 - DNA, 201 bp, Bos taurus; identical to SEQ ID NO: 33246

SEQ ID NO: 114180 - DNA, 201 bp, Bos taurus; identical to SEQ ID NO: 33247

SEQ ID NO: 114181 - DNA, 201 bp, Bos taurus; identical to SEQ ID NO: 33248

SEQ ID NO: 114182 - DNA, 201 bp, Bos taurus; identical to SEQ ID NO: 33249

SEQ ID NO: 114183 - DNA, 201 bp, Bos taurus; identical to SEQ ID NO: 33250

SEQ ID NO: 114184 - DNA, 201 bp, Bos taurus; identical to SEQ ID NO: 33251

SEQ ID NO: 114185 - DNA, 201 bp, Bos taurus; identical to SEQ ID NO: 33252

SEQ ID NO: 114186 - DNA, 201 bp, Bos taurus; identical to SEQ ID NO: 33254

SEQ ID NO: 114187 - DNA, 201 bp, Bos taurus; identical to SEQ ID NO: 33255

SEQ ID NO: 114188 - DNA, 201 bp, Bos taurus; identical to SEQ ID NO: 33256

SEQ ID NO: 114189 - DNA, 201 bp, Bos taurus; identical to SEQ ID NO: 33257

SEQ ID NO: 114190 - DNA, 201 bp, Bos taurus; identical to SEQ ID NO: 33258

SEQ ID NO: 114191 - DNA, 201 bp, Bos taurus; identical to SEQ ID NO: 33259

SEQ ID NO: 114192 - DNA, 201 bp, Bos taurus; identical to SEQ ID NO: 33260

SEQ ID NO: 114193 - DNA, 201 bp, Bos taurus; identical to SEQ ID NO: 33261

SEQ ID NO: 114194 - DNA, 201 bp, Bos taurus; identical to SEQ ID NO: 33262

SEQ ID NO: 114195 - DNA, 201 bp, Bos taurus; identical to SEQ ID NO: 33263

SEQ ID NO: 114196 - DNA, 201 bp, Bos taurus; identical to SEQ ID NO: 33264

SEQ ID NO: 114197 - DNA, 201 bp, Bos taurus; identical to SEQ ID NO: 33265

SEQ ID NO: 114198 - DNA, 201 bp, Bos taurus; identical to SEQ ID NO: 33266

SEQ ID NO: 114199 - DNA, 201 bp, Bos taurus; identical to SEQ ID NO: 33267

SEQ ID NO: 114200 - DNA, 201 bp, Bos taurus; identical to SEQ ID NO: 33268

SEQ ID NO: 114201 - DNA, 201 bp, Bos taurus; identical to SEQ ID NO: 33269

SEQ ID NO: 114202 - DNA, 201 bp, Bos taurus; identical to SEQ ID NO: 33270

SEQ ID NO: 114203 - DNA, 201 bp, Bos taurus; identical to SEQ ID NO: 33271

SEQ ID NO: 114204 - DNA, 201 bp, Bos taurus; identical to SEQ ID NO: 33272

SEQ ID NO: 114205 - DNA, 201 bp, Bos taurus; identical to SEQ ID NO: 33273

SEQ ID NO: 114206 - DNA, 201 bp, Bos taurus; identical to SEQ ID NO: 33274

SEQ ID NO: 114207 - DNA, 201 bp, Bos taurus; identical to SEQ ID NO: 33275

SEQ ID NO: 114208 - DNA, 201 bp, Bos taurus; identical to SEQ ID NO: 33276

SEQ ID NO: 114209 - DNA, 201 bp, Bos taurus; identical to SEQ ID NO: 33277

SEQ ID NO: 114210 - DNA, 201 bp, Bos taurus; identical to SEQ ID NO: 33278

SEQ ID NO: 114211 - DNA, 201 bp, Bos taurus; identical to SEQ ID NO: 33279

SEQ ID NO: 114212 - DNA, 201 bp, Bos taurus; identical to SEQ ID NO: 33280

SEQ ID NO: 114213 - DNA, 201 bp, Bos taurus; identical to SEQ ID NO: 33281

SEQ ID NO: 114214 - DNA, 201 bp, Bos taurus; identical to SEQ ID NO: 33282

SEQ ID NO: 114215 - DNA, 201 bp, Bos taurus; identical to SEQ ID NO: 33283

SEQ ID NO: 114216 - DNA, 201 bp, Bos taurus; identical to SEQ ID NO: 33284

SEQ ID NO: 114217 - DNA, 201 bp, Bos taurus; identical to SEQ ID NO: 33285

SEQ ID NO: 114218 - DNA, 201 bp, Bos taurus; identical to SEQ ID NO: 33286

SEQ ID NO: 114219 - DNA, 201 bp, Bos taurus; identical to SEQ ID NO: 33287

SEQ ID NO: 114220 - DNA, 201 bp, Bos taurus; identical to SEQ ID NO: 33288

SEQ ID NO: 114221 - DNA, 201 bp, Bos taurus; identical to SEQ ID NO: 33289

SEQ ID NO: 114222 - DNA, 201 bp, Bos taurus; identical to SEQ ID NO: 33290

SEQ ID NO: 114223 - DNA, 201 bp, Bos taurus; identical to SEQ ID NO: 33291

SEQ ID NO: 114224 - DNA, 201 bp, Bos taurus; identical to SEQ ID NO: 33292

SEQ ID NO: 114225 - DNA, 201 bp, Bos taurus; identical to SEQ ID NO: 33293

SEQ ID NO: 114226 - DNA, 201 bp, Bos taurus; identical to SEQ ID NO: 33294

SEQ ID NO: 114227 - DNA, 201 bp, Bos taurus; identical to SEQ ID NO: 33295

SEQ ID NO: 114228 - DNA, 201 bp, Bos taurus; identical to SEQ ID NO: 33296

SEQ ID NO: 114229 - DNA, 201 bp, Bos taurus; identical to SEQ ID NO: 33297

SEQ ID NO: 114230 - DNA, 201 bp, Bos taurus; identical to SEQ ID NO: 33298

SEQ ID NO: 114231 - DNA, 201 bp, Bos taurus; identical to SEQ ID NO: 33299

SEQ ID NO: 114232 - DNA, 201 bp, Bos taurus; identical to SEQ ID NO: 33300

SEQ ID NO: 114233 - DNA, 201 bp, Bos taurus; identical to SEQ ID NO: 33301

SEQ ID NO: 114234 - DNA, 201 bp, Bos taurus; identical to SEQ ID NO: 33302

SEQ ID NO: 114235 - DNA, 201 bp, Bos taurus; identical to SEQ ID NO: 33303

SEQ ID NO: 114236 - DNA, 201 bp, Bos taurus
cccctccctgccggaactgcgagtggtagtagctgatggccgtgtactcgttgagacagggagccggcaggtgctcccggggactggggggccgcgggggratcagatcttccaggttctggttgctgtaacggggtgggagaggtgctcgcttgttttccagctccagtgggaaggggaaacccccgtagaggccactgg

SEQ ID NO: 114237 - DNA, 201 bp, Bos taurus; identical to SEQ ID NO: 72902

SEQ ID NO: 114238 - DNA, 201 bp, Bos taurus; identical to SEQ ID NO: 72903

SEQ ID NO: 114239 - DNA, 201 bp, Bos taurus; identical to SEQ ID NO: 72904

SEQ ID NO: 114240 - DNA, 201 bp, Bos taurus; identical to SEQ ID NO: 72905

SEQ ID NO: 114241 - DNA, 201 bp, Bos taurus; identical to SEQ ID NO: 72906

SEQ ID NO: 114242 - DNA, 201 bp, Bos taurus; identical to SEQ ID NO: 72907

SEQ ID NO: 114243 - DNA, 201 bp, Bos taurus; identical to SEQ ID NO: 72908

SEQ ID NO: 114244 - DNA, 201 bp, Bos taurus; identical to SEQ ID NO: 72909

SEQ ID NO: 114245 - DNA, 201 bp, Bos taurus
tgtatataaccccagttccaccatctcagggatgtttagcgtaatgggtccttggccaagttattttatatatgtgtacttccatgtccttatgcagaaamatatggattattcttatatcacctattcacaaagcttttgtagttctcacaatactttgggaaaatactttgtagctcccaagatatttttgcagtttat

SEQ ID NO: 114246 - DNA, 201 bp, Bos taurus
tcatttaattaaaaacttttatggataacctcctgaataccaattaccgtattttgaacaagagtgattcaatccttcacctgatggcctttagagtctartggagtttctcatcctcatttcaacttttacttcttatggtgttacggaacacaggtttgtgtgcccgacacacagtgaggccaaacaaacctccatgtt

SEQ ID NO: 114247 - DNA, 201 bp, Bos taurus; identical to SEQ ID NO: 72911

SEQ ID NO: 114248 - DNA, 201 bp, Bos taurus
ccagaggtcttcaactaattatcagtcttctaaagtacagagaggaatcttaactaaacaatttcttataagtactaaccctcaccatctggcctagacgrtatcaacccttttctgctacagcatacacaacacgtggtgttccaatgagtgacggtttcccatgggcacaatcgcaccttgatatggcctcagaaacct

SEQ ID NO: 114249 - DNA, 201 bp, Bos taurus
cagtaacacattagtagtacaggacttttacatcaatggatagatcatccagacagaaaatcaataaggaaacagtggccttcaaaaacatatgcaacccratagacttaatagatatatatacaatacaccccaaatcagtagaacatacattcttttcaagtgcacatagaattttctccaggatagagcacatgctag

SEQ ID NO: 114250 - DNA, 201 bp, Bos taurus
actgggtgaaactggagcattgtgtggatctgaagcagagatgtgtcacttacataacccaccatgcgctcttggattcgagttactttccttagaccccrctatgcccctacaagactgatgggaaaaacactgtagttgacacatttagaaatggaggcttagaagattggcaagtttacaaggctcataatagccagg

SEQ ID NO: 114251 - DNA, 201 bp, Bos taurus
actgtttcccataaaaaaataaaataaaataaagatgtatacaaagcaatgcatagcacgagcatctactactctttctttgtgactaatacccctgtatytcactctgtctgcctttagccactcattcaagagcttcgctttgtttgttttggccacattgcacagcatgtgggatctcagttccccgaccagggattg

SEQ ID NO: 114252 - DNA, 201 bp, Bos taurus
agatgctatgttacaagagttggagcacagcatctctggagcaacacagtagaacctgctgtctaagttattcagaggaggttttacattttaagtctcaraagtggatgagtgggaaactccatgtggcaaacaaggacacgtgcagcctcctcactctcacagacattagctctgggccgtctgccacacacacgtcac

SEQ ID NO: 114253 - DNA, 201 bp, Bos taurus
caccaaaggtgactgtaattctttttactagaaatgcttctctttctttcattggtaacactaacactttgagatactgatataatcattatcgattttgytatcattcatcatgacggccttaagagaggtcagttccctatttctttacaatagcaaagtcaagaaaaacaacactgcagattatcatcctttttatac

SEQ ID NO: 114254 - DNA, 201 bp, Bos taurus; identical to SEQ ID NO: 72913

SEQ ID NO: 114255 - DNA, 201 bp, Bos taurus; identical to SEQ ID NO: 72915

SEQ ID NO: 114256 - DNA, 201 bp, Bos taurus; identical to SEQ ID NO: 72916

SEQ ID NO: 114257 - DNA, 201 bp, Bos taurus
tgaattcaaactctctgataaatgaaaagcaaaatattttttaaaagagccccaaattaaaccattgaggattatttaccataagttacacaacacattcygcaatctactcttgaataagatacactgcatcacaaaatactgtaaacagtgaaacagtaatagctgggtgtcttaatttgtgaccttaagttaatttct

SEQ ID NO: 114258 - DNA, 201 bp, Bos taurus
atctcttccagctcacactgactcctggacatgcccagagtgaagtggagagtcacatttgcatttaaatctcctgttgcatttcatttagtctttctggygcagcacataaacataattcaattcagtaagtgaaattcctgcctgtgagtccatcaaacatgttgctctgattgcccattttttagtctgataaaatac

SEQ ID NO: 114259 - DNA, 201 bp, Bos taurus; identical to SEQ ID NO: 72918

SEQ ID NO: 114260 - DNA, 201 bp, Bos taurus; identical to SEQ ID NO: 72919

SEQ ID NO: 114261 - DNA, 201 bp, Bos taurus; identical to SEQ ID NO: 72920

SEQ ID NO: 114262 - DNA, 201 bp, Bos taurus; identical to SEQ ID NO: 72921

SEQ ID NO: 114263 - DNA, 201 bp, Bos taurus; identical to SEQ ID NO: 72922

SEQ ID NO: 114264 - DNA, 201 bp, Bos taurus
caagtctgtgcgaccccaagactgagggactaacacacacatacacacacataggtagggctagttaagtgtgtctggataaaccacaatctgagcaaggyaggtttttgttttgttttgttttttggttttggattaaggcagctaaaactaagactagtctcaaatctgaataaagcaggcaaatgcctagatggtggg

SEQ ID NO: 114265 - DNA, 201 bp, Bos taurus
agcccactttggcctcctttgcatggcaaagcaataaatcttttctatttcatccaaaaccctgtctctaagaattaaatcactctagggtacagaggccygatttggcttcattaggaagttactgaatctttctgagtctcagtttcctcatctaccaagagcacataatgatagtacccacctcaaagggttgtcaga

SEQ ID NO: 114266 - DNA, 201 bp, Bos taurus; identical to SEQ ID NO: 72925

SEQ ID NO: 114267 - DNA, 201 bp, Bos taurus; identical to SEQ ID NO: 72926

SEQ ID NO: 114268 - DNA, 201 bp, Bos taurus
gactgccatgaccccggcccctggtgtgcctcctgccacagagtgcatgccaaatggttgagtcaagagtcgacttagaatgtgaccattggatgagaaakctggaggaacaggatcccctggccacttgtccggctccatcttcctgacccactccagcccagatgtggaatttctgtgggtgtgccagaaatctgcatg

SEQ ID NO: 114269 - DNA, 201 bp, Bos taurus
ttcacagatttgagtaatctatgtggattattgcaaccaagtacagactccttttgaggatgctgcctggaggcagacaaaccaagtaaaaatggagtgaraatacctacagatatagttattcactttgcttgacttctctgatagtgtcacatcccatgccagtctccctacctcaggagtttcatactgtctggtcca

SEQ ID NO: 114270 - DNA, 201 bp, Bos taurus
gaaggtttagtgaatgcttgattctctttccatcttattatgtgcattcaatattaagacagtgttttgtctcctaatttaggagttagatctcaactcaycttgtgatctgagaagtggactgattgaacccttgtctgcaaaagagaaaactaagattggtgacatcttaggtgagtggtctgtgcacctcacaaagtt

SEQ ID NO: 114271 - DNA, 201 bp, Bos taurus
gaagagggagagggcccagcagtaccgtatgagatggaggtggtgcatctgggactgagcacaagtaggactagtgagtacaagtaaacttcaacaagtarcccagaagtctatgttatctgtcagtgttgcactaggaccccttcctcagcttatacctctggccacatgggatttcctttttttttgtcctctggccat

SEQ ID NO: 114272 - DNA, 201 bp, Bos taurus
ttctgtatccccaggattaaagttgtacatcacaacacatttatttaccccctccccacttcacacttttcctgacatctcctgtatctgaggaaatgtgyctaactcaagggatgactactggaaagtccttgttctcaacagagtttgctttcatgcctacaggttctgtctcagacgttgggggcgaaatgaattcca

SEQ ID NO: 114273 - DNA, 201 bp, Bos taurus
tgggtgccttatctattactatgggttgttatttccttccaaaaaagaaggaaatttatcctaactcattttcaccatgtgcttgttacacttccctttgyctcactatattcaaatatcttttcactgtgttcaagccccttcctcccttaccccatagtaatgtctcccagaaggaaacgaccatggaatctcattcct

SEQ ID NO: 114274 - DNA, 201 bp, Bos taurus
ctgaaaaacaaaataacttaattgtcttgtgttctctgttggctgtcatctcttcagtacatgcacttgcatctcacacaccgttaataggttcagagaaractcagcttacacacaggccagtgttcttgactccttgggagtatgtctcgtggtcttgcccaagtccttgaaaacacagtccaggcgtttgtgttccca

SEQ ID NO: 114275 - DNA, 201 bp, Bos taurus; identical to SEQ ID NO: 72930

SEQ ID NO: 114276 - DNA, 201 bp, Bos taurus
aggacagttgggttggaaaaagatattagggggcctaagtttaagcaagcacactttgatttccgtaacagttttggttgggatggcccccattccaccaygtcaatccaaggcatgctatttctctaatgatgatcaaagtctttcctgatatgtaatgttaattcactatctttgaattaattcactcttttttttcta

SEQ ID NO: 114277 - DNA, 201 bp, Bos taurus; identical to SEQ ID NO: 72932

SEQ ID NO: 114278 - DNA, 201 bp, Bos taurus; identical to SEQ ID NO: 72933

SEQ ID NO: 114279 - DNA, 201 bp, Bos taurus; identical to SEQ ID NO: 72934

SEQ ID NO: 114280 - DNA, 201 bp, Bos taurus; identical to SEQ ID NO: 72935

SEQ ID NO: 114281 - DNA, 201 bp, Bos taurus; identical to SEQ ID NO: 72941

SEQ ID NO: 114282 - DNA, 201 bp, Bos taurus
cgatttcttttcagttttactgaaattatcctttgataaaaatggggtggtagaggaacaatccactctgctcaaaatcaatggcttactttacttaagarcagactgttttcagaatggaaaatagttcttcaaatatttgttcattttcagaggagccatgataacagtctccatttattccatcctcacgtcctacct

SEQ ID NO: 114283 - DNA, 201 bp, Bos taurus; identical to SEQ ID NO: 72942

SEQ ID NO: 114284 - DNA, 201 bp, Bos taurus; identical to SEQ ID NO: 72944

SEQ ID NO: 114285 - DNA, 201 bp, Bos taurus; identical to SEQ ID NO: 72945

SEQ ID NO: 114286 - DNA, 201 bp, Bos taurus; identical to SEQ ID NO: 72946

SEQ ID NO: 114287 - DNA, 201 bp, Bos taurus
gtggccttatcgtttgtaaatgatgtgccaagcataagagctggcattgttttgtggaggcagggagaggggactgcctagaattcttcactttgtggtcygcttagggggcctggaatgcaaaagtaggaagtcaagaaacacctggagtaacaggcaaatttggccttggaatatggaatgaagcagggcaaagactaa

SEQ ID NO: 114288 - DNA, 201 bp, Bos taurus
ttattacctgagggccatgtgaacacatttggctggggcgccgtgacacacagttgacacagtcacctcataaaatgttcatagctgattaaggggcataygctccttcagaggcctgggtgtcccgaagagagaaagaacagctgtttcctatgctctcattaagggcttaaagccttcttcacattaaagagcttccat

SEQ ID NO: 114289 - DNA, 201 bp, Bos taurus
gtgttcagggctttgatgaccagccctataccccacatcagcccctgccacagctcgaccttccaaccaggaaggagactatcagagatgttgaaggcagrggccatcttgctgctgttcatccctctgcccatgagccaggagggttctgcagccagcagactgggaatcaagacacactcaggaaaaggtctaagcctc

SEQ ID NO: 114290 - DNA, 201 bp, Bos taurus; identical to SEQ ID NO: 72948

SEQ ID NO: 114291 - DNA, 201 bp, Bos taurus
tgtgtggtcttaaaacatttgccaaaatgtttacagagatgctttctctggatagtggaataagaagttgatttctcttttgttttctatcttttccagargtttaccataagcacatagtttgataattttttaaaagctgttttcatttagtggttaaataatgcaaataatatacagttatattagatatgttgaatt

SEQ ID NO: 114292 - DNA, 201 bp, Bos taurus; identical to SEQ ID NO: 72951

SEQ ID NO: 114293 - DNA, 201 bp, Bos taurus
ttatgatgcattggtgatgcgctgagatggtaaacatgcagtgtaatgatgggcgggggaatgtagcaggaagtgaggagaagcatcttaggcacttttcrttatcaaatcttttggttttaacatgcatgtgttagcttttgtgctagtgtgtgccactagaggagaacgataaagggcaaaaatgagccaaggtcataa

SEQ ID NO: 114294 - DNA, 201 bp, Bos taurus; identical to SEQ ID NO: 72953

SEQ ID NO: 114295 - DNA, 201 bp, Bos taurus; identical to SEQ ID NO: 72954

SEQ ID NO: 114296 - DNA, 201 bp, Bos taurus
ttggggatttcctgggttcaagaaccccaaacatctcagcaacccagtgggctggaaacacaagcatcatcgtgacacttgggggtatttttcatagccayctatgtcacagtttcctagtaccaaatcacagggtctgagggccaaagaacttaggtagagatgtccccaaagcagtcaggggcacgtttgaggtcatct

SEQ ID NO: 114297 - DNA, 201 bp, Bos taurus
ccctctgcttcaagcacttgaaaaagggaaatactttcttcataatgatggtagtagctgactcctttccccggagcaacaaaaatcaccagtgactaccrggatacctggtctagagatgcattaggtggattaatagtgcttaatggtgagtgaaaggaacaagttctctgttttaaaacatgcagtgctctgagaaag

SEQ ID NO: 114298 - DNA, 201 bp, Bos taurus
ccaggtagaactggttctagaaacaaaattcacaggactctcccatagaggtagcaaaaggagagcgtgtagagatgacaagggccaggtggcctattaargctatttatgatgctgaggggaagaagccctggagactgtcaggcagggacccaaggaccagagctgtgggccccaggccgtgctctgctggaagcgcaa

SEQ ID NO: 114299 - DNA, 201 bp, Bos taurus; identical to SEQ ID NO: 72958

SEQ ID NO: 114300 - DNA, 201 bp, Bos taurus
cctacaattctgcagtaaatcaatcaacaacgagtctgaaaaacaggcaaaaaacttaaatagacatttctccaaaaatgaaatacaaatggccaattagyatataagaaaattctaaacatcactaatcattaaagaatgctaatcaaaattacagtgaatataacctcatatctattagaatggccataaaagaaagag

SEQ ID NO: 114301 - DNA, 201 bp, Bos taurus
caagtttgatcaaaagtaaatatgaaacataaagaaacagcaagtattattccataacaaaatattatagaagaaaagaaacactgatttacatagtagamtaatttgaaaacaaatcaatactttaatgccgttagaccttttctttaaaaaaaaaaaaaaaaagaagctcgtttcactcagtttaaagattttgctttt

SEQ ID NO: 114302 - DNA, 201 bp, Bos taurus; identical to SEQ ID NO: 72964

SEQ ID NO: 114303 - DNA, 201 bp, Bos taurus
caaattatatataatagggccaattagtagagaaggagcctgaacatctttagagaagatgtgagaaggtatggttggcttaagattaaaactaattgtcktacttcatttgttctcatttctttttctctgcaactttaaataaagtacccgtaaatttcagattaaaacaaagaaaaagccaaggtaaagttatgacaa

SEQ ID NO: 114304 - DNA, 201 bp, Bos taurus; identical to SEQ ID NO: 33317

SEQ ID NO: 114305 - DNA, 201 bp, Bos taurus; identical to SEQ ID NO: 33318

SEQ ID NO: 114306 - DNA, 201 bp, Bos taurus; identical to SEQ ID NO: 33319

SEQ ID NO: 114307 - DNA, 201 bp, Bos taurus; identical to SEQ ID NO: 33320

SEQ ID NO: 114308 - DNA, 201 bp, Bos taurus; identical to SEQ ID NO: 33321

SEQ ID NO: 114309 - DNA, 201 bp, Bos taurus; identical to SEQ ID NO: 72979

SEQ ID NO: 114310 - DNA, 201 bp, Bos taurus; identical to SEQ ID NO: 33323

SEQ ID NO: 114311 - DNA, 201 bp, Bos taurus
ccttagtattgacccacataaaataccttataattccttagtcagtgatttcaaggactatgtggtgaacactcatatacactttatacagatttcaccarttgttaacgttttgccatatgttttacacgtacactgttttttttcctgaactcatagagaattagttgaatttcaccccaaagtacttcaccatgtatc

SEQ ID NO: 114312 - DNA, 201 bp, Bos taurus; identical to SEQ ID NO: 33324

SEQ ID NO: 114313 - DNA, 201 bp, Bos taurus; identical to SEQ ID NO: 33325

SEQ ID NO: 114314 - DNA, 201 bp, Bos taurus; identical to SEQ ID NO: 72984

SEQ ID NO: 114315 - DNA, 201 bp, Bos taurus
tttcggtgaagttaatattattcttccataaatagtatgcttgattacgagaagatcacaaatctacaaaggagaaaactaaccgcccttagtcatttccyaaggtccttagtctaaacattgtgatattttgtcaaaagattgagtcacataaaataaaaacgtatgtagaccaagcagttgactaccagtttgcatcct

SEQ ID NO: 114316 - DNA, 201 bp, Bos taurus; identical to SEQ ID NO: 72988

SEQ ID NO: 114317 - DNA, 201 bp, Bos taurus; identical to SEQ ID NO: 33330

SEQ ID NO: 114318 - DNA, 201 bp, Bos taurus
taatgtgaaattctgttgtaaagggtatagtataaaataaacattaagagccagagactgtttttatctgttccccttcttctaccacctgtctatggaaytaaaataaaaattttttttcaaacaggtaagaacactttacctgtgtttacccatttccatatctattttctgtagcccatggagaacatttcatgagaa

SEQ ID NO: 114319 - DNA, 201 bp, Bos taurus
caaaatcacatgatcatcttaaaagattcagaaaaagcatttgataaaattcaacctccattcacaataaaaactttcaaagtgagtatggagggaacacrtcaacctaataaaggccacaaactacaactaacgtactctgtggtgaaaagaagaaagcttttccttttaaatcaacaataagacaaggatgcccgctat

SEQ ID NO: 114320 - DNA, 201 bp, Bos taurus; identical to SEQ ID NO: 33332

SEQ ID NO: 114321 - DNA, 201 bp, Bos taurus; identical to SEQ ID NO: 33334

SEQ ID NO: 114322 - DNA, 201 bp, Bos taurus; identical to SEQ ID NO: 33335

SEQ ID NO: 114323 - DNA, 201 bp, Bos taurus
gtagaagtcagtaaagtaacattgtgaacagacaagtgagaaaagatcttatactcattattagttctaagaaaaatttctacttgttcagagtatggccrtagctcattcctcacatgtaaaagatgagatcagagagaagcaaacatggacagaagacttaaacagacatttctccaaagaagacacatagggccaaca

SEQ ID NO: 114324 - DNA, 201 bp, Bos taurus; identical to SEQ ID NO: 33336

SEQ ID NO: 114325 - DNA, 201 bp, Bos taurus; identical to SEQ ID NO: 33338

SEQ ID NO: 114326 - DNA, 201 bp, Bos taurus
gatcacagtaactactttttaaaaatactaacttcagcctatttttggtataaagtttggttttacttgtgtttagaagtccaacatagtcacagtttggygctttattgaatctttgaacaggaatttttcatggaaaatgtggtttctactacctggttttactggagaaacagaattgtcctggacttaaatactaca

SEQ ID NO: 114327 - DNA, 201 bp, Bos taurus
tttatgcagtcattgaatgcattcaaggccatattatcccttcattagaggttgagtgttcagttctatttagaaggaggaaagcaacagaatacaatcayaatcaaagggcccaatcagcataaatttaacttaaagagtagtttgcctttttataacatgaggtcaggcagcatactatactttccatactataagttt

SEQ ID NO: 114328 - DNA, 201 bp, Bos taurus; identical to SEQ ID NO: 33339

SEQ ID NO: 114329 - DNA, 201 bp, Bos taurus; identical to SEQ ID NO: 33340

SEQ ID NO: 114330 - DNA, 201 bp, Bos taurus
gtggagaaggagatctagcctcaggcacacgatagctttccagtatgactctgcctcctaagtactgtgataaaggtagagatttctttatgccttttatyagtttctgatgagcaccttaatttcccatgtggcttcagaactgagccggtttcaattagggaaaactgaccatgctttaggaactttgctagatttcaa

SEQ ID NO: 114331 - DNA, 201 bp, Bos taurus; identical to SEQ ID NO: 33341

SEQ ID NO: 114332 - DNA, 201 bp, Bos taurus
cacagctaaagaattcttaaaatgagtgtaaactaattgagtaaacatgctaattatgctaattaaaatacattcatactaaagtgtaaatgacttctaaytcttccattaaagaaaaataaaacagggacaacagcaggctgcaccagaagagatggtggaatatagagaaaaaaaagctaaagacccagaagataaatt

SEQ ID NO: 114333 - DNA, 201 bp, Bos taurus
tggagaatttgactgagttgtcccacatcagagcaggtccacagtccttgggcagaggctggctgggtgctagagaaatgctctgggtagtacctgctggrggagctgctgaactaacaggaagcagtagcccacagaccaccaggaagcaagctggggagccacaggatctagactttctttctgatgaatttccatcag

SEQ ID NO: 114334 - DNA, 201 bp, Bos taurus
tttataaagcatagaaatccatcccagagaaaatgggtgtggcccaaggcataggacaaataaaatatagagtcagaaagagagctgaactgtatgtattraaaccttagtcaagagttatctttttgtccacatgcttttatctgtctttccagtaaactctctcaaggatttttaagataggtcttgctttccctactg

SEQ ID NO: 114335 - DNA, 201 bp, Bos taurus
aaaaaaataaatgttgtctttatgggctgttacaccttattgccataattaccttcctactcctgtcttatttctgcatccttgactccaaaacaactttkttaaagacatcaatgatttccacactggaaatccaaagaacacttttaagcaaaattatcttattggagtatagttgatttacaatggtgtgttaatttg

SEQ ID NO: 114336 - DNA, 201 bp, Bos taurus
ctttcttttgttgcatagctcatagtttttgctttcctatataaactcaggacccaccttgaagtctctctgtgtgaacataggtgagagtgcatggccargataaatgcaaaggagcaacatttaaatgatacatcctactcagagcacaatgtttttctctccagggccttgatttggcagcaaagaaaggaagattta

SEQ ID NO: 114337 - DNA, 201 bp, Bos taurus
ctgaaactagtctattaattatttcctagggtctgagcagtagattttaaaatggattattcagagaactagatttttttttcttttccctcatgtgcctygctacttttaatttttcttggctggtggggttggaggcactaaaccaccactgttgtcttaaccaaagcaataatatttatacccatttttaatacggag

SEQ ID NO: 114338 - DNA, 201 bp, Bos taurus; identical to SEQ ID NO: 33343

SEQ ID NO: 114339 - DNA, 201 bp, Bos taurus
catctttatttgaatgagtttcctgccctgtattttcagctgaattagagaaaaattatttgttcatgacaagcaatgacttttgagcaggtgtattaagmattagatttcaccaaagccagattttaacataatttttgcaaagcgttaagcaaaagcttttagaaaaactagctaagaatactcaaattagtattttat

SEQ ID NO: 114340 - DNA, 201 bp, Bos taurus; identical to SEQ ID NO: 33345

SEQ ID NO: 114341 - DNA, 201 bp, Bos taurus
accataggaaagaactggtttatgttagatgctcaccaagtatttggtgtattatctcagtttctgatgctatcattaaataagataaacttggccaaggyaaatgtaatttcctctacttggattatcagttcagttcagttgctcagccatgtccgactctttgcgaccccatgtgtcgcagcacgccaggcctccctg

SEQ ID NO: 114342 - DNA, 201 bp, Bos taurus
ttttgtacctaatactaaaaagagatgataatgaaacttttgaaagaaggccatatggacttactaagtaccttagctatattattctgaataactttgaractccttaagagaagcatttttttaaaagattttttgatgtggatcattctctaagtctttattaaatttgttatggtattgctgttttgtgttttggct

SEQ ID NO: 114343 - DNA, 201 bp, Bos taurus; identical to SEQ ID NO: 33347

SEQ ID NO: 114344 - DNA, 201 bp, Bos taurus; identical to SEQ ID NO: 33348

SEQ ID NO: 114345 - DNA, 201 bp, Bos taurus; identical to SEQ ID NO: 33349

SEQ ID NO: 114346 - DNA, 201 bp, Bos taurus
aggttaagagactccagtgctgacaaggtgataatgaggatttatggagagagggaggtaagggtgggtggaccctcccaggctcccacatgtggtggctmcaggccctctgcagacagagtacctcaacggaagtgaaggttaccttctggattgcagaagcaaccaagcctggctacattgtgattaaatgcacacaca

SEQ ID NO: 114347 - DNA, 201 bp, Bos taurus
ggagacactgtccgcttattcctcctgttcacttattagagctcagctgcagtttacctctatagcctccttgagccccacttttgaaaatgattcctgtratgcaagccttttattctgtgcttcagttttccttactaatgctcgtcatgatttgtagtcacgaatctgtgatgtgtctactttttaatgtcttttcat

SEQ ID NO: 114348 - DNA, 201 bp, Bos taurus
agcatgagaggagggggcagctcagtaagaggagctggtgacttgcattagcatttgatatctttcttttctgagcgggtatctttgttttttaccctgartctcttagaccatccaataaggatatcagtccccaccccttttatgaagaaggaaattcagggataaaattgggatccagaactggcttgatcaattgct

SEQ ID NO: 114349 - DNA, 201 bp, Bos taurus; identical to SEQ ID NO: 33352

SEQ ID NO: 114350 - DNA, 201 bp, Bos taurus; identical to SEQ ID NO: 33356

SEQ ID NO: 114351 - DNA, 201 bp, Bos taurus; identical to SEQ ID NO: 33359

SEQ ID NO: 114352 - DNA, 201 bp, Bos taurus; identical to SEQ ID NO: 33361

SEQ ID NO: 114353 - DNA, 201 bp, Bos taurus; identical to SEQ ID NO: 33362

SEQ ID NO: 114354 - DNA, 201 bp, Bos taurus; identical to SEQ ID NO: 33364

SEQ ID NO: 114355 - DNA, 201 bp, Bos taurus; identical to SEQ ID NO: 33365

SEQ ID NO: 114356 - DNA, 201 bp, Bos taurus
actaatgtatgatggggtggtgctagccatctttgcaccgagagttactcctcctttcaaggccccttgttggtgtatcttgcccacaggtatagggctgrtgaagggggcctgatcactttcatgatttcatgattcatgactcgacagactgccaaaacaccccaagaaatatgtaactcgtctattctaagtcctgcc

SEQ ID NO: 114357 - DNA, 201 bp, Bos taurus
tgttgttaaattctggactgaaaaccaagagaaaatatcacattagcaaaataacaagccttcagtgcgtaaccctgaaagaaaaggttactatggtttcraagcatttcatacactcttccagttagttttttgaaaacagtggagctttttggagctttttttttggtttatttttaactttgagacattttcctctgg

SEQ ID NO: 114358 - DNA, 201 bp, Bos taurus
atgaaagcctcatatctgcccctagaattactgcagtggatccatggaataatatatatgaaaatacttcacttttgtccagtagatgaagttgtcctaaygtttagagctcaaggaaacatgacgctgctgttgagtccaagagaaaactgagaaaagggagaatgtgggtcccttctgtctcgttggcttccttttcca

SEQ ID NO: 114359 - DNA, 201 bp, Bos taurus
tttgggtttgtcattattcaccacaggacaagtgatataatatatctgatcatcttcacttacgcggtctatgacttcacaggacctaggtaaacagaacmgtgacagaaagtctacacttttctacctggtagaataaggcatgcctttcttttgtttgtttgggtaacttcattattggtgtctgtattcacccttctg

SEQ ID NO: 114360 - DNA, 201 bp, Bos taurus; identical to SEQ ID NO: 33367

SEQ ID NO: 114361 - DNA, 201 bp, Bos taurus; identical to SEQ ID NO: 33368

SEQ ID NO: 114362 - DNA, 201 bp, Bos taurus; identical to SEQ ID NO: 33369

SEQ ID NO: 114363 - DNA, 201 bp, Bos taurus
tgctgatgactggggtgggttgttcagtcttatcatcacgcctgacctagttgtgcagctgctcctgtttaattaatagacatttacataagctcttttcycccagcaagctttataatggtcgtgttggttatctcctttcgctctgtgaagtatcagcagtgctatttccatttccatatcaaaatacagagagattaa

SEQ ID NO: 114364 - DNA, 201 bp, Bos taurus
ggatatttcaacttgcattctatcaattcagcaacagagaagtcattgcaaaggtaaaactaacatgacagacgatatttgtatactctcagtttttcackgaacttgactactccacagacatttgattgaaagcctgctcatgctggtggttgaaatccaatttgcagtaagtcacttgttcactgtcaaggttaacag

SEQ ID NO: 114365 - DNA, 201 bp, Bos taurus; identical to SEQ ID NO: 33374

SEQ ID NO: 114366 - DNA, 201 bp, Bos taurus
gtggacacagaatcttgaaaagatgtgaatagtgcttggtctatgccggacttattctaaatcatgaattggggaaaacacacttaaagagctcagaccakagctgtgagtgagatgtgtatttctcagacaatatcactggggtttgaaaggcatgggatgcccctgtggaaataacttggagaaatgtgctagagattt

SEQ ID NO: 114367 - DNA, 201 bp, Bos taurus
ggcctaagatgtgaattctattagcttggtagactctgtggcgatgatccactcactacctgtgcttggatgtggcagcctggcagcattagtggtctccratcttcaccctcccttaggccccggtcctttgccgtgtgactttgcatgtggaggtgaagtatatatccttgcttcttgattaaggccttcggctggcag

SEQ ID NO: 114368 - DNA, 201 bp, Bos taurus
cacccccctcaaaactatggggccaaaaacttgtgacactatttttttcatgtataagccactaacgtggatatgtattcctcggaggcgggcagataccygtgactggccgaggtttaggagagtttgcacgtcaaggagtttcctggttccctgtctagtaatctgctctgctgcccgggagagtaaaccacagttaat

SEQ ID NO: 114369 - DNA, 201 bp, Bos taurus
tgcttgatgaagcatttcatcaagtaggccacagagctatttgccttctgcgtatgcatgggaggcaggcagtgaatctggttgagaggaagccacgtagyccagggcctgattttctctacaggccaagtctcaaagtccatcttcaggctcctgagggggtgtttccaagctcgagatgtcagctctgctttctcagga

SEQ ID NO: 114370 - DNA, 201 bp, Bos taurus
tgtactgcaatactcttaggcattatggtggcaaatattgtgatgactacaagatgcattaactaagattatacatgtcaggttgaactctttcttcaatrtatcaccttggtgactccaaggttattaaaactgctgagaccaggagtgttaacagttggtgatagggtttcagggataattctgttattgttgactgaa

SEQ ID NO: 114371 - DNA, 201 bp, Bos taurus; identical to SEQ ID NO: 33376

SEQ ID NO: 114372 - DNA, 201 bp, Bos taurus
atggccccacccatcaaaacaaaatccagtcctccttcccccccactcaccaccaccagtcagtctatcctataaggaagcttccataaggtctcttatayttctccagacaaatgaaaacaatcattgaaaactaagcaaactgatcacatggaccatagccttgtctaactcaatgaaactatgagccatgacgtgtag

SEQ ID NO: 114373 - DNA, 201 bp, Bos taurus
ttataataatttgcaggcccagtgcaaaatgaaaacgcagagcccctttgttcagaattattaagaatttgaagatagtgacaacagaacatgaaagcagrgatgaagcccctctaagcttgtggccttgtgtgactgacagcatagtcatacacccatgaaggtggcattgtctgtggttctttaacaacctcactcatt

SEQ ID NO: 114374 - DNA, 201 bp, Bos taurus; identical to SEQ ID NO: 33377

SEQ ID NO: 114375 - DNA, 201 bp, Bos taurus
gctcggtggccgcgtaaacacgctgtaaccaagttctgggctaatttttacagagtttcgtttgctccccagaagaaccgacggtactcaatggtctcctrcgggcctgcccccacaagagcctgggggctcctttcccctaagccagcactggcagcgcggggggcggggaagagggggtggggaagggtgggagggcag

SEQ ID NO: 114376 - DNA, 201 bp, Bos taurus
aacaccctgggctctttgctcttaattttttttatcatttactttgattagtcttggattgttttttctactgatatatctcttcctctttttgtgtaatstaacattatatatatataaataaaatatataaacttagatacgcattatacgtatattatatatatatattaaatcccagaagtttaacaacttcttaaa

SEQ ID NO: 114377 - DNA, 201 bp, Bos taurus; identical to SEQ ID NO: 33378

SEQ ID NO: 114378 - DNA, 201 bp, Bos taurus
acactgcggccacattctacttctgcttctgtgattcacggggtcgaggcaggtgtggtgcctcagcccagcccacagacttctgagcggcccaccatccyttctcctctggaaataagccctgaaacacaggcagctttgatcagaggggaggattccacagtagcggcccccaaacagcaagtaccgacgaggatgctt

SEQ ID NO: 114379 - DNA, 201 bp, Bos taurus
tttttgttgataaaacaaaaatgcaaaaaagcaagagaaagcaaatacaaggcgtagcttttttctctctcagattccccagagagaatcccaccagcgaygccacatttaccggtcaccgccctgtagtaacactgtctcctagagtctcgtacgaaaatgatttctcgagaactttccatgaggctaagcgctggcctt

SEQ ID NO: 114380 - DNA, 201 bp, Bos taurus
cccttcataatgacatcagatcctcgtgactgactagcagaaaaccttttgtaaaatgagtgcttaatggtatccactcctccttcaccaaaaccttatayattgatggtcccccactgcatctttggaacagttcctcagaactatttgaggtgctgcctcccaggcttcagtcttcctgttgccccaaagaaaacttgc

SEQ ID NO: 114381 - DNA, 201 bp, Bos taurus; identical to SEQ ID NO: 72990

SEQ ID NO: 114382 - DNA, 201 bp, Bos taurus; identical to SEQ ID NO: 72991

SEQ ID NO: 114383 - DNA, 201 bp, Bos taurus; identical to SEQ ID NO: 33388

SEQ ID NO: 114384 - DNA, 201 bp, Bos taurus
ttctctgtgttcatgcattcctggggacttttcctctttaaggactccagacctattgaattaaggctccaccctcatgacttcctttagccttaattgcyttccagaggccctgtatccaaatattgtcacactgtggggtttgagatttaggtatggattttggtggagaacagtacaatccataacatgaactttcca

SEQ ID NO: 114385 - DNA, 201 bp, Bos taurus; identical to SEQ ID NO: 33389

SEQ ID NO: 114386 - DNA, 201 bp, Bos taurus; identical to SEQ ID NO: 72994

SEQ ID NO: 114387 - DNA, 201 bp, Bos taurus; identical to SEQ ID NO: 72995

SEQ ID NO: 114388 - DNA, 201 bp, Bos taurus; identical to SEQ ID NO: 33392

SEQ ID NO: 114389 - DNA, 201 bp, Bos taurus; identical to SEQ ID NO: 72996

SEQ ID NO: 114390 - DNA, 201 bp, Bos taurus; identical to SEQ ID NO: 33393

SEQ ID NO: 114391 - DNA, 201 bp, Bos taurus; identical to SEQ ID NO: 72997

SEQ ID NO: 114392 - DNA, 201 bp, Bos taurus; identical to SEQ ID NO: 33395

SEQ ID NO: 114393 - DNA, 201 bp, Bos taurus
cggccctataaacaaaaccgtgataagaaaagggcaatttagtagctagaatagtggatttccaccctcttccctttggcctcactccagagtggatgaaygtaaggagccaactgtttgaaatggctcttcactaagaactctaatgaaagacattagagaacaattgttgtagaactccaccaggttatgaactatggc

SEQ ID NO: 114394 - DNA, 201 bp, Bos taurus
tctgtgagtagaaaccaggacgtgaagccacacttgccttgggaatggattgtttctggtccagcttgggactgaggactgcgtgtgaaaaggagatctcmgggtcttctgtctttcagaggattgatgagaagggtagtttataaactcacccggaactttgagtccatgtgaaagtctagacaggtttcattcatgttg

SEQ ID NO: 114395 - DNA, 201 bp, Bos taurus; identical to SEQ ID NO: 33396

SEQ ID NO: 114396 - DNA, 201 bp, Bos taurus
ttgtgtttttagaaaatatttcttttcacaaactagatttcagccatattataactattaacgagtacatattcatatttggagcattgtctgtctcattytctgagtatttgaaatgcaaagcaagcagaaagaggatggtaagaaggtcttgcaggcccaaatcttcctctacctcatattaatactacagagaggaaa

SEQ ID NO: 114397 - DNA, 201 bp, Bos taurus; identical to SEQ ID NO: 33399

SEQ ID NO: 114398 - DNA, 201 bp, Bos taurus; identical to SEQ ID NO: 33402

SEQ ID NO: 114399 - DNA, 201 bp, Bos taurus; identical to SEQ ID NO: 33403

SEQ ID NO: 114400 - DNA, 201 bp, Bos taurus
cagcacgggtcttgagatgtcattattcccacgttatgataaggcactcacttatgctgctttacaggagaaagaaccaaagtttaaaaagccagagccaytgatttatattacactactgtaacactcttaaatagaatcttattttaaaagacaggacctggaagagaaaaagctttaccggcttaatccacgatcatg

SEQ ID NO: 114401 - DNA, 201 bp, Bos taurus
tagtttacttttgtctttatattctggaatggatcccattcagattacatccttcaagaattacatcagccccagttcaaagttgttcacctccaaaccakataaatccacacattactttctaagtgagggcattcaccagactagtgtaatactgtcttccatgtcctgggacggctggaaattatcttagttccctga

SEQ ID NO: 114402 - DNA, 201 bp, Bos taurus; identical to SEQ ID NO: 73003

SEQ ID NO: 114403 - DNA, 201 bp, Bos taurus; identical to SEQ ID NO: 73004

SEQ ID NO: 114404 - DNA, 201 bp, Bos taurus; identical to SEQ ID NO: 73006

SEQ ID NO: 114405 - DNA, 201 bp, Bos taurus; identical to SEQ ID NO: 73007

SEQ ID NO: 114406 - DNA, 201 bp, Bos taurus; identical to SEQ ID NO: 73009

SEQ ID NO: 114407 - DNA, 201 bp, Bos taurus; identical to SEQ ID NO: 73014

SEQ ID NO: 114408 - DNA, 201 bp, Bos taurus; identical to SEQ ID NO: 73015

SEQ ID NO: 114409 - DNA, 201 bp, Bos taurus
aaaactgtaagaggttactgaaaggaaacaaataataaaacaggtttaagtacctataaaactcaggcttaaggagtaggaaactgctgctgaaggaaagrtaatattttattgtgaaatgttcatttatttccattcaacccaatttattaaacacctattattttaagtcattaaaataaatgatcagcatttacagaa

SEQ ID NO: 114410 - DNA, 201 bp, Bos taurus; identical to SEQ ID NO: 33409

SEQ ID NO: 114411 - DNA, 201 bp, Bos taurus; identical to SEQ ID NO: 73017

SEQ ID NO: 114412 - DNA, 201 bp, Bos taurus; identical to SEQ ID NO: 33411

SEQ ID NO: 114413 - DNA, 201 bp, Bos taurus; identical to SEQ ID NO: 33412

SEQ ID NO: 114414 - DNA, 201 bp, Bos taurus; identical to SEQ ID NO: 33413

SEQ ID NO: 114415 - DNA, 201 bp, Bos taurus; identical to SEQ ID NO: 33414

SEQ ID NO: 114416 - DNA, 201 bp, Bos taurus; identical to SEQ ID NO: 33416

SEQ ID NO: 114417 - DNA, 201 bp, Bos taurus; identical to SEQ ID NO: 73026

SEQ ID NO: 114418 - DNA, 201 bp, Bos taurus; identical to SEQ ID NO: 33417

SEQ ID NO: 114419 - DNA, 201 bp, Bos taurus
agtttgtcattagatccaagtcacattggtaagattactttggccaccaacatataaatactgtcaatgtagatggttttgggggggcagcctccttctcyctagatcatacacatggccattcacccagcagattgcctttctttctaagcacaatggtttctctttctttttcctgtaagggcttgatccaaggttgtt

SEQ ID NO: 114420 - DNA, 201 bp, Bos taurus
ggtgcctcaattcttcctagaaaataaaaattcaaataatcacacacatcaatgtaaaattaaatctgtcaggaagattgcaagtgggaatgatgtgaggrtatgtaataagaagatctgatgtagggaaagttgctgcgagaagtgatgcttaaaccgacatttaacgacatgtaaaaactggcagtgaacattagctag

SEQ ID NO: 114421 - DNA, 201 bp, Bos taurus; identical to SEQ ID NO: 73027

SEQ ID NO: 114422 - DNA, 201 bp, Bos taurus; identical to SEQ ID NO: 73028

SEQ ID NO: 114423 - DNA, 201 bp, Bos taurus; identical to SEQ ID NO: 73029

SEQ ID NO: 114424 - DNA, 201 bp, Bos taurus; identical to SEQ ID NO: 73030

SEQ ID NO: 114425 - DNA, 201 bp, Bos taurus; identical to SEQ ID NO: 73032

SEQ ID NO: 114426 - DNA, 201 bp, Bos taurus; identical to SEQ ID NO: 33426

SEQ ID NO: 114427 - DNA, 201 bp, Bos taurus; identical to SEQ ID NO: 33427

SEQ ID NO: 114428 - DNA, 201 bp, Bos taurus; identical to SEQ ID NO: 33430

SEQ ID NO: 114429 - DNA, 201 bp, Bos taurus; identical to SEQ ID NO: 33431

SEQ ID NO: 114430 - DNA, 201 bp, Bos taurus; identical to SEQ ID NO: 33433

SEQ ID NO: 114431 - DNA, 201 bp, Bos taurus; identical to SEQ ID NO: 33435

SEQ ID NO: 114432 - DNA, 201 bp, Bos taurus; identical to SEQ ID NO: 33436

SEQ ID NO: 114433 - DNA, 201 bp, Bos taurus; identical to SEQ ID NO: 73043

SEQ ID NO: 114434 - DNA, 201 bp, Bos taurus; identical to SEQ ID NO: 33450

SEQ ID NO: 114435 - DNA, 201 bp, Bos taurus
tggcttgtggccaatcttctgcctctgtcttcatgtttccttttcttatttgtgtgttgtatctccttctgcctctttcttataaggatgcttgtgactgmatgtgggcccactcagaggatccaggatcatctacccatctgttcagttcagttcagctcaattcagttgctcagtcgtgtctgactctttgcgacccca

SEQ ID NO: 114436 - DNA, 201 bp, Bos taurus
ttgctatagaaaggagaaaacattctaggaaaaacctcataagcatttcagtcagagaagttgggaggggctttttattggatttgaatttattttggatkattttgaggaggatttagggaagtagaggactgttattaaagtgagataagtcagaaagacagatactgtatgatatcactcatatgtggaatctaaaga

SEQ ID NO: 114437 - DNA, 201 bp, Bos taurus
ccatgtatctgcagtcagctggcagtttgactacagcaacagggtgactcaactctgtgctgtctttatccagcaggccagcccaggcttgtttgtatggyggcagcaagtttcaaagaaagaacttgaatcatgtacgccccttggggccaaggcttagaattggcacgtttccactgttggtcagagcaaatcacaaga

SEQ ID NO: 114438 - DNA, 201 bp, Bos taurus
acaaaatagaagttgccagggattaggccaatagagagtaagctggtaaggaaggaaatcaccttttgagaggcaatttttaagtgaaacctaagtaggtrctgtctggggaggccttacaaatagctgtgaaaagaagagaagcaaaaagcaaaggagaaaaggaaagatataaacatctgaatgcagggttccaaagaa

SEQ ID NO: 114439 - DNA, 201 bp, Bos taurus; identical to SEQ ID NO: 73061

SEQ ID NO: 114440 - DNA, 201 bp, Bos taurus; identical to SEQ ID NO: 73062

SEQ ID NO: 114441 - DNA, 201 bp, Bos taurus; identical to SEQ ID NO: 73063

SEQ ID NO: 114442 - DNA, 201 bp, Bos taurus; identical to SEQ ID NO: 33455

SEQ ID NO: 114443 - DNA, 201 bp, Bos taurus; identical to SEQ ID NO: 73068

SEQ ID NO: 114444 - DNA, 201 bp, Bos taurus; identical to SEQ ID NO: 33462

SEQ ID NO: 114445 - DNA, 201 bp, Bos taurus; identical to SEQ ID NO: 73073

SEQ ID NO: 114446 - DNA, 201 bp, Bos taurus; identical to SEQ ID NO: 73074

SEQ ID NO: 114447 - DNA, 201 bp, Bos taurus; identical to SEQ ID NO: 73077

SEQ ID NO: 114448 - DNA, 201 bp, Bos taurus; identical to SEQ ID NO: 73078

SEQ ID NO: 114449 - DNA, 201 bp, Bos taurus; identical to SEQ ID NO: 73081

SEQ ID NO: 114450 - DNA, 201 bp, Bos taurus; identical to SEQ ID NO: 73082

SEQ ID NO: 114451 - DNA, 201 bp, Bos taurus; identical to SEQ ID NO: 33468

SEQ ID NO: 114452 - DNA, 201 bp, Bos taurus; identical to SEQ ID NO: 73085

SEQ ID NO: 114453 - DNA, 201 bp, Bos taurus; identical to SEQ ID NO: 73086

SEQ ID NO: 114454 - DNA, 201 bp, Bos taurus
ctgtggggtgtagcccaacaccccagtggacaagcctgccaggaggctgggggagactcctgtgagctccaggatgtcaggaaataaggatggagaatggraagttacaggggtaattccaaggcggctgcccgctagcttgtggggccctgtgacagctatatctgctatgagaaatgtctttctcttccattatgttgg

SEQ ID NO: 114455 - DNA, 201 bp, Bos taurus
cacaccctgagcacgttgtctgagtttcgtctggactgggttgatggttttttactcatactatgattttgccctttggtaagctgagttcgttaactgartctattttgcctccttcactataaactctaactagttgcctcagggtgtctgtgttgtgcaagtaattcaagggctggaggttgtgcgtttttatttttt

SEQ ID NO: 114456 - DNA, 201 bp, Bos taurus; identical to SEQ ID NO: 33507

SEQ ID NO: 114457 - DNA, 201 bp, Bos taurus; identical to SEQ ID NO: 33508

SEQ ID NO: 114458 - DNA, 201 bp, Bos taurus; identical to SEQ ID NO: 33509

SEQ ID NO: 114459 - DNA, 201 bp, Bos taurus; identical to SEQ ID NO: 33512

SEQ ID NO: 114460 - DNA, 201 bp, Bos taurus; identical to SEQ ID NO: 33513

SEQ ID NO: 114461 - DNA, 201 bp, Bos taurus; identical to SEQ ID NO: 33514

SEQ ID NO: 114462 - DNA, 201 bp, Bos taurus; identical to SEQ ID NO: 33515

SEQ ID NO: 114463 - DNA, 201 bp, Bos taurus
tatcacagaattttaaaggaaacggacagcccgcggcttgagaatctattaagagcgccaagtctaaccactgacgtgcttacctaccatgagttcatctrtagtcgctgcaccttccagccccccggctgccccgaggccatgggtgaggtgttgaaagggcctgacccaagggcagaagaaggctttctgagaagcacc

SEQ ID NO: 114464 - DNA, 201 bp, Bos taurus
tgcagaagtgatgtaagcagcacagaggcctccccttagataagacgcattcttgataggtccctattcctcaggtgcggtgggaaatctcaacttcctgyggaatggagagggccggacacggtatgtcgtagatgctaacattgaaaactgacagccttgggacttccctggccgtccagtggtgaagactctgccttc

SEQ ID NO: 114465 - DNA, 201 bp, Bos taurus; identical to SEQ ID NO: 33517

SEQ ID NO: 114466 - DNA, 201 bp, Bos taurus; identical to SEQ ID NO: 33518

SEQ ID NO: 114467 - DNA, 201 bp, Bos taurus
agaaatcttccttggggagaaatcttccttgggtgtggcagaatgggtgtgccccattcctgtcagtctggttccatgatgtactacaggtacacctgtgmgttttgacagcgaggttttaaatttaggaaatccacagtcatcactttgacactttgaggagtggctgcttgtcacaatgagttaaaacatgcttatgag

SEQ ID NO: 114468 - DNA, 201 bp, Bos taurus; identical to SEQ ID NO: 33523

SEQ ID NO: 114469 - DNA, 201 bp, Bos taurus; identical to SEQ ID NO: 33524

SEQ ID NO: 114470 - DNA, 201 bp, Bos taurus; identical to SEQ ID NO: 33529

SEQ ID NO: 114471 - DNA, 201 bp, Bos taurus
gactagtagataacccagttttaaagaagatagaaaatcagcaataggatctcatgataaaatattctattaatttatgcaggctttcaccttgaaatgtratctgtgaaagatcaccttacttgtgttttcatgacttcatctaatccaaaaagtaaatatgatgagtttacttgctaagcttttgcacatgagattata

SEQ ID NO: 114472 - DNA, 201 bp, Bos taurus; identical to SEQ ID NO: 33532

SEQ ID NO: 114473 - DNA, 201 bp, Bos taurus; identical to SEQ ID NO: 33533

SEQ ID NO: 114474 - DNA, 201 bp, Bos taurus; identical to SEQ ID NO: 33537

SEQ ID NO: 114475 - DNA, 201 bp, Bos taurus; identical to SEQ ID NO: 33543

SEQ ID NO: 114476 - DNA, 201 bp, Bos taurus
ggaaatggccctgagctgggctgggtgtggggctctgtgaccgggatctgagggcagtggctttgggagggaggggctgcccaaggctgagctgtgatggrggctatagaagtcccaggcccaccccagagagcccggatcgcaggtgttctcctggggagagggaggctgaatctgggacctccgcctggacagtcactc

SEQ ID NO: 114477 - DNA, 201 bp, Bos taurus
ataattgttttcagagcataaatctaattttaatggagggaatgtaattccgtctctacctcttacaccttgcaggttattttggcagccagaagcttttycccatagaatagaaatccacccaccactcttcccctttgtcgtgggcggtccagagtggcagacttcacggctggccactgtcactgtcctcattgctga

SEQ ID NO: 114478 - DNA, 201 bp, Bos taurus
ccctatggtggccaagttatcttacctagaaatagatttaaagaacagaaacaggtttctgacaataacaatttattttagatttatttagataacatacrtgaaaatacctaatgcaatccagaagggctttaggaaaaaaccaacttacagctgtattgaactaaaaaaaaaaaaaaggtaaagtaagagctttaaaaa

SEQ ID NO: 114479 - DNA, 201 bp, Bos taurus
atggggccgatgcttcacaaacctgcccgtgtcctgaggagtatgtggaagttacacttactctccgtggacagatggagtcaggttctgctcatcccgtrtgtcctgtcggccctctgtcctgcccctcagcatcctctcgtctccctgaaggaattcttgtgccctgagtgaaagcgtatctcctgtataaggtctgtg

SEQ ID NO: 114480 - DNA, 201 bp, Bos taurus
actttggatccctccctcgtgaagaagcagaaatttattagcacctcagttgactcttactgtgtttggacttggcttacttctcttctgcaaaccatacyatccatagtctgtccatggaccagtactggtccagtgcctattacgatctaggcttcacagcaggaggtgagtggtgggcaaatgaaagaagtttcatct

SEQ ID NO: 114481 - DNA, 201 bp, Bos taurus
gctctgctaacctctggggccacgcttgtctctgtgccagcactccattgaagccacacattccattataaccacacattccaccctgctgctaatggccsatgttgcaacagacctggcaacaaggatacctcatttaggtgtcatttgtttcctttaaaaattactatccaaggcccaatgctcacttcctgttttgaa

SEQ ID NO: 114482 - DNA, 201 bp, Bos taurus
ctgacccatcaccacctctcagcccgatgagccattcaagatgggtacctctgaaaagagttcaggctttttataagcaagtcagtctgtcttttgaaagycttccttttctttcatttttgctatgaacgtacgaaagctggcttctgctctgtaaggaggaaaaccagagcccatgggaagcgacaatgatctcaacgt

SEQ ID NO: 114483 - DNA, 201 bp, Bos taurus
aagagaaacttgaggacaattgtaatgagtatatttaaagcattgaaagatgtgaaatttctcttcaatcaaagtgtctctttgattttaatttcctaacygtgacttaacattatggcagttcagtttttacatctttctatgaatatatttttagtgctttactcagaaaggaataacagtatttcagaatgtctaagg

SEQ ID NO: 114484 - DNA, 201 bp, Bos taurus
ctcctgggcctgcaaacggccaccttctccctgtgtcctgacatcgtctttctctgtgcgttacctgatgttaccctgtgtgtcccaatctctggttcttrtacagataataattagattagggccccataattatggcctttactttaacttaatccctcctttaaaaaaccctatctctaaatacaatcacattttgag

SEQ ID NO: 114485 - DNA, 201 bp, Bos taurus
gactataaagtcttgactgttaccttcatttgttgacttacttttaattggctactctggcacctggcagctcacctctccagctcagcagagctcctgayaacattaggctccaacttttttgtaatccttcccaaatctgttatttaagtattagagaatatctgggaaaagcaaaactttgaaaaagaattaatcctg

SEQ ID NO: 114486 - DNA, 201 bp, Bos taurus
tgaagattaagtgttgcgtatcaacatacccagttcgtgtctgccccccaccaccccgcccccgttcccaattcatatgttgaagccctaggccccagtgygacagtgttggaaggcagggcctttggagatgattagatgttgtgatcatgggaatagagctttttggtgggattattgtccttacagaggaacagagac

SEQ ID NO: 114487 - DNA, 201 bp, Bos taurus; identical to SEQ ID NO: 33548

SEQ ID NO: 114488 - DNA, 201 bp, Bos taurus; identical to SEQ ID NO: 33550

SEQ ID NO: 114489 - DNA, 201 bp, Bos taurus; identical to SEQ ID NO: 33551

SEQ ID NO: 114490 - DNA, 201 bp, Bos taurus; identical to SEQ ID NO: 73126

SEQ ID NO: 114491 - DNA, 201 bp, Bos taurus; identical to SEQ ID NO: 33552

SEQ ID NO: 114492 - DNA, 201 bp, Bos taurus; identical to SEQ ID NO: 33555

SEQ ID NO: 114493 - DNA, 201 bp, Bos taurus; identical to SEQ ID NO: 73131

SEQ ID NO: 114494 - DNA, 201 bp, Bos taurus
catgtaataacttagtgacttgccccaaagttgccatagttaaatgtaaagaagttgaaaacaaatctctgaatttcctatccatagttgctatcttggtyagacacatggcctctgatactagatatgaaaaagatattctctttacctagtgcactcaattcaccagcaacataacaagacggaaatgaggtgcaaatt

SEQ ID NO: 114495 - DNA, 201 bp, Bos taurus
gccaaagatacactatatgaacatagaatggtggactctccctccattgtgcatctctatactgttttcttattctgtctacaaatatttattaattttayttttatcttttccctttaaacacaacaaactttactggttgctttatgaacactgtaattaagttaaacaaaacataagtgcaaaaagaagttaatttca

SEQ ID NO: 114496 - DNA, 201 bp, Bos taurus; identical to SEQ ID NO: 33557

SEQ ID NO: 114497 - DNA, 201 bp, Bos taurus; identical to SEQ ID NO: 33558

SEQ ID NO: 114498 - DNA, 201 bp, Bos taurus; identical to SEQ ID NO: 33559

SEQ ID NO: 114499 - DNA, 201 bp, Bos taurus
ctggagaattccatgggcagagaagcctggtggcctaaagtccacagggctgcaaaaagttggacacgactgagcaactacagggaatgatttatgaaaamatgtaaagggataaattattatgaagttagaaaagatgaagcagtcttttcccttccttcctgagaagtcctgtattaacatggcccatactggtttgcc

SEQ ID NO: 114500 - DNA, 201 bp, Bos taurus
agcccagaaaggcaggagatgatcactttcagggcttctcaggttgctctgctttctctgttactctgcaaatctatgaaattatcttctgggcctggtayccagtgttacctagcactctagtttttccaggactcaggaggacatagttgggggctttaaactcattgatggacatgggggaaaaaaaaaaaggaagga

SEQ ID NO: 114501 - DNA, 201 bp, Bos taurus; identical to SEQ ID NO: 33560

SEQ ID NO: 114502 - DNA, 201 bp, Bos taurus; identical to SEQ ID NO: 33564

SEQ ID NO: 114503 - DNA, 201 bp, Bos taurus; identical to SEQ ID NO: 33566

SEQ ID NO: 114504 - DNA, 201 bp, Bos taurus; identical to SEQ ID NO: 33567

SEQ ID NO: 114505 - DNA, 201 bp, Bos taurus; identical to SEQ ID NO: 73141

SEQ ID NO: 114506 - DNA, 201 bp, Bos taurus; identical to SEQ ID NO: 33570

SEQ ID NO: 114507 - DNA, 201 bp, Bos taurus
cttggaccccaaggccctgcatcatctggctcttacctacctttccagactcaccttggaatgtcctacctctggcatcttttctgctcatctagcaagcrggctttttcgcatctcagggcctttgcacttgttctctctgtccgggatctcttcctctaggtctatgcatggctgtctcctttgtgttcttccttagct

SEQ ID NO: 114508 - DNA, 201 bp, Bos taurus; identical to SEQ ID NO: 33571

SEQ ID NO: 114509 - DNA, 201 bp, Bos taurus
gcctttaatgaatttggaaacagagttgaaactctaatgtcctttgatttctcttgcgatttgatttgtgatcataaagggcctcaaaaggtcaaacaccrgactcagaattaggaaaagcagtgtgctttcaaaatacttacatcaaggtctgtggccaaagtgattcacacagtttagtctctgagggtaaaggaggtt

SEQ ID NO: 114510 - DNA, 201 bp, Bos taurus; identical to SEQ ID NO: 33572

SEQ ID NO: 114511 - DNA, 201 bp, Bos taurus; identical to SEQ ID NO: 33575

SEQ ID NO: 114512 - DNA, 201 bp, Bos taurus; identical to SEQ ID NO: 73148

SEQ ID NO: 114513 - DNA, 201 bp, Bos taurus; identical to SEQ ID NO: 33580

SEQ ID NO: 114514 - DNA, 201 bp, Bos taurus
tccaaagatcatagtgtcagtgccaacatgaatatccatgcactcaggtaaataggaaatgtgcagtttttttttttttccttctaggtcagaatgtcctrtgtaattgatggtgaattgaaataggttgctgattttcaaaacagcttagatacaagcttcccgtttattatggtaatgagattgagacgttgtgaaact

SEQ ID NO: 114515 - DNA, 201 bp, Bos taurus; identical to SEQ ID NO: 33582

SEQ ID NO: 114516 - DNA, 201 bp, Bos taurus; identical to SEQ ID NO: 33583

SEQ ID NO: 114517 - DNA, 201 bp, Bos taurus; identical to SEQ ID NO: 33588

SEQ ID NO: 114518 - DNA, 201 bp, Bos taurus; identical to SEQ ID NO: 73154

SEQ ID NO: 114519 - DNA, 201 bp, Bos taurus; identical to SEQ ID NO: 33593

SEQ ID NO: 114520 - DNA, 201 bp, Bos taurus
tatcaaaaattaaagttatattaaataagaagagtgatgaagattgcacacatatggaacattaaaatacattttttttaatatttgaagaaaaagggtgratctttaaaggaaatttctcaatttattcaattcaaggaagaatattttttccaaaatagatgtatttatttgaaagtaaaagagaaatagatgttataa

SEQ ID NO: 114521 - DNA, 201 bp, Bos taurus
tgccttctccgaccactagtgctacttccccataatttctggccttacctgcagcttcagtgacagccagatatggcctgaagtataaggaagattttaayaggtcagaacactgtctccttagagatcagctttatgtctgtcttctgctctgtggtggccttgagtcatcctctctgatttctgggattccagattcat

SEQ ID NO: 114522 - DNA, 201 bp, Bos taurus
atatttattagcatggcatttatttatacatagaagaaaccaaaaataacttagtaatcattgttacttgcacttagcaaaaacagaatcaggattcataygagaaagaagaaagggagaagggaaacccatagacagtttaaaaacagtaaattttggataaagggataattagctaaacaggggggctaatcaaggtgt

SEQ ID NO: 114523 - DNA, 201 bp, Bos taurus
ctaggataagttagtttgccgacattctggagacactagagcataagcaggatgctggagagaatgttccattctattggttggtcaagtagacaatgccrttccatcccctctgagacatggaggctgcagagacccgttccctggaggatggccaggcccacaagccctgaagctagaggtgtactttcctgttctatt

SEQ ID NO: 114524 - DNA, 201 bp, Bos taurus
ttctggggcaaaggggctgccccaagctgttcacctggccctagggtgatgagagaaaaggaattttagccctaagtgtgagcagccatagaggaggtggyttggggagtgggccctggattggttagtttgtattgactggtgagtaaacagctcaaggatgagttggttactatctctagaaattggtgagtcctgatc

SEQ ID NO: 114525 - DNA, 201 bp, Bos taurus; identical to SEQ ID NO: 73163

SEQ ID NO: 114526 - DNA, 201 bp, Bos taurus
caccctcctgttcctagggctccatggatattacccatgaaatgattcaactaccaaacacagaagaagcatttgtcatgagaggagtggatagtgggagyatttttttttaatagtaaatcattagattcagcaactactaaaccatggaaattaaagacaactcatccaaaaggcaagcctcgtttcacacttccagga

SEQ ID NO: 114527 - DNA, 201 bp, Bos taurus; identical to SEQ ID NO: 33601

SEQ ID NO: 114528 - DNA, 201 bp, Bos taurus; identical to SEQ ID NO: 33606

SEQ ID NO: 114529 - DNA, 201 bp, Bos taurus
ctcctcccctggcatgcgaaggcttgcatggattcagtttttgagccttcctctctcctgccggcctcagcccatcacccaggtgggcgcacggcctccckctctccctcgacctgaatcttgagtggagatatctcatgatgcaaacagcctgcggctcatttgtcctgatagcggagccctgaggacatggcccgtttg

SEQ ID NO: 114530 - DNA, 201 bp, Bos taurus
attcccaacaagtttataagaatagtcttttgtttacttgggataatatggtgcactatattaatatttaagttccttgaatgctgtgaactcctcaaacrtatctgaatgaatgactgaacctttgtaaattaagggacacttgtacgaataaagtgattttatggttttaactaaggtcaggtctaagtaggtcttgaa

SEQ ID NO: 114531 - DNA, 201 bp, Bos taurus; identical to SEQ ID NO: 33609

SEQ ID NO: 114532 - DNA, 201 bp, Bos taurus; identical to SEQ ID NO: 33610

SEQ ID NO: 114533 - DNA, 201 bp, Bos taurus; identical to SEQ ID NO: 33611

SEQ ID NO: 114534 - DNA, 201 bp, Bos taurus; identical to SEQ ID NO: 33612

SEQ ID NO: 114535 - DNA, 201 bp, Bos taurus; identical to SEQ ID NO: 33613

SEQ ID NO: 114536 - DNA, 201 bp, Bos taurus; identical to SEQ ID NO: 33614

SEQ ID NO: 114537 - DNA, 201 bp, Bos taurus; identical to SEQ ID NO: 33616

SEQ ID NO: 114538 - DNA, 201 bp, Bos taurus; identical to SEQ ID NO: 73173

SEQ ID NO: 114539 - DNA, 201 bp, Bos taurus
actaagattcacattcctactgcaagtagtaaagaattaacttctatagatttgcttgaaataaatagaaaaagaaaacaacctgagagcaaatgcaaacygaatgttgataagaaaggtagataaacagaagctcatcttgccaagaacatgatacaaatgcttataaattcattgtggtattataacttgatgagtaca

SEQ ID NO: 114540 - DNA, 201 bp, Bos taurus; identical to SEQ ID NO: 33618

SEQ ID NO: 114541 - DNA, 201 bp, Bos taurus; identical to SEQ ID NO: 73176

SEQ ID NO: 114542 - DNA, 201 bp, Bos taurus
ccactcctcttctactccattctcattactcttttagaaaaccttggttaacaaggatatatctttcattattttatcaaaacctaattggttataagcamacagatacacacacaaacatataaatacatttatacacataattgcttgttattaagaattatacacagttctgcatattgattttcatagttacatatt

SEQ ID NO: 114543 - DNA, 201 bp, Bos taurus; identical to SEQ ID NO: 73180

SEQ ID NO: 114544 - DNA, 201 bp, Bos taurus; identical to SEQ ID NO: 33622

SEQ ID NO: 114545 - DNA, 201 bp, Bos taurus; identical to SEQ ID NO: 33627

SEQ ID NO: 114546 - DNA, 201 bp, Bos taurus; identical to SEQ ID NO: 33628

SEQ ID NO: 114547 - DNA, 201 bp, Bos taurus; identical to SEQ ID NO: 73184

SEQ ID NO: 114548 - DNA, 201 bp, Bos taurus; identical to SEQ ID NO: 33630

SEQ ID NO: 114549 - DNA, 201 bp, Bos taurus
gatggcaagtaagacagtcgtggtttctgccaccaagaagcttacattctgctagcataaacaaacaataaacagggtaaataaattagataattaactakatagtaaactaacaagtgctgtgaagaaaggcaaatgttatagagtattatcaggctacctgatttaggtttagggaatagacaagggatatcaaaatgt

SEQ ID NO: 114550 - DNA, 201 bp, Bos taurus; identical to SEQ ID NO: 33632

SEQ ID NO: 114551 - DNA, 201 bp, Bos taurus
cttctcaattcttagaacctataacattcctgtatacatcaagcatctctgagaccagactctgctgtgcagcatttcccaaacttgacagtgactttttycccccagaaacatttaaccagattattgttctgccaaaaatcggttacagaattagcatagcaattttcctggtccacgtaggttgatttctcagccgtg

SEQ ID NO: 114552 - DNA, 201 bp, Bos taurus; identical to SEQ ID NO: 73189

SEQ ID NO: 114553 - DNA, 201 bp, Bos taurus; identical to SEQ ID NO: 73190

SEQ ID NO: 114554 - DNA, 201 bp, Bos taurus; identical to SEQ ID NO: 73191

SEQ ID NO: 114555 - DNA, 201 bp, Bos taurus; identical to SEQ ID NO: 33633

SEQ ID NO: 114556 - DNA, 201 bp, Bos taurus
tagtgattggcaaagtcagaatactaataacccagacaaatcatttgatttctactgtcttaaattgcaaactgatagttttcgtctaaacctcatatctkcttaaagcattaactttggacctttacatccctcacagcatgcaggatattgattatccacacattttttttttgttgtacagttgctaagttgtatcta

SEQ ID NO: 114557 - DNA, 201 bp, Bos taurus; identical to SEQ ID NO: 33634

SEQ ID NO: 114558 - DNA, 201 bp, Bos taurus
gtcggggaaagggtctatctccgagccttgcgagcgggtgcccagcccttggcggggcgttcagccccggaccgaggccggcgagcctgcagagcttagcraagtcaggcagccaccgagtgtcagagactggcgacgctgcgggactccgcggcctccaggagactgggaggtgacagcaaggcccgatccactcagtgg

SEQ ID NO: 114559 - DNA, 201 bp, Bos taurus
aaacttgttatttaatttctcttaggctacatttcctaatttgtacagagaagccactaatatctacactgtaaatattacagtgggatgagtaaaaaccrataaaaatatcccaagagctaaaagtaacatatcacaaatatgatatttggggttgtccagatatttgagttatagtcttaaaaatataagattttaaaa

SEQ ID NO: 114560 - DNA, 201 bp, Bos taurus
ttgcatccaaaaacttatagtaacgaagtagagatttgtaacctatgtaaattctgtaattacttgatttctattttaggagtacataggataatattgcsattattttaagttagagaaatattcattttatatttgttgtataaagagttaaaatataaaaatggtaggttcattttaaatagccatttatttctcgtt

SEQ ID NO: 114561 - DNA, 201 bp, Bos taurus; identical to SEQ ID NO: 33637

SEQ ID NO: 114562 - DNA, 201 bp, Bos taurus; identical to SEQ ID NO: 33638

SEQ ID NO: 114563 - DNA, 201 bp, Bos taurus
agtgttattaattgcataataaaaaagcaggtagtaaatctccccaggctttaattgctctgtgtgaacttatctgtaggcaataaaggctgattctcacrgctgagatctgggagccaaggcagctgaagagattggtgtagctacactgaccccgacctcctctctcctccaggtggaaatggcaccacaggtagctca

SEQ ID NO: 114564 - DNA, 201 bp, Bos taurus; identical to SEQ ID NO: 33639

SEQ ID NO: 114565 - DNA, 201 bp, Bos taurus; identical to SEQ ID NO: 33640

SEQ ID NO: 114566 - DNA, 201 bp, Bos taurus
cattttgatgtatatgtgtgtcatgaaaccagataatggtattttgaaaatgaaatatttaatttttcctcccgtaatataactgcccatttggaaagggraagagtgtataatcttcattacaaggtttgctgactggtagcattatcttttgtgtgttccttaaagaacatctggccatctaataatcccccaaaatat

SEQ ID NO: 114567 - DNA, 201 bp, Bos taurus
ggaacctacaaccttaggactaaacacatagggtaaaaggacttaagttgtcacaaaagtatggtattggatgagttagttaaatgtcaatagatgcaggrcaggatggtgacaaaaagtgttacccatttactcctgatttctgtgtatttccccgtcaattgggaagaatatgacctttggaactgtataaagcctggt

SEQ ID NO: 114568 - DNA, 201 bp, Bos taurus
aagttcgtaattgcacttgataaatgagtaacctttggatagctttcctgtaggtgtttgcagtgactttggaatcctaagtttgtaacttttttccagcygcatttccaaggttctgctttgtcagaggaactgctgtttatctggtaaagagtaatttatttaattgatgagatttttatttgtatacaatcaacaata

SEQ ID NO: 114569 - DNA, 201 bp, Bos taurus; identical to SEQ ID NO: 73192

SEQ ID NO: 114570 - DNA, 201 bp, Bos taurus; identical to SEQ ID NO: 73193

SEQ ID NO: 114571 - DNA, 201 bp, Bos taurus; identical to SEQ ID NO: 33643

SEQ ID NO: 114572 - DNA, 201 bp, Bos taurus
taaaatgacttaggccaaaaatggcttctcttatgtcaagaaagtcatgtctgattttctttctctggggacccactaccctacctgttaacaaaactagycatctgtgggcctctagaatttgtaggcacagggcttcccatgggcatgctaggtgggaattaggctgagaaccaccaccttaattgttaaatgggcatg

SEQ ID NO: 114573 - DNA, 201 bp, Bos taurus
cacagagggttctcagtgcctccacggactctccccaaactgaagacagggggtccacagcttcccctgagagaggcagctgagtgagggcgtggaaaggkccgcagtgcagaccgccctgcctcacggtgtgtttcgttactaaagttggtaagcttctgttaccacagcattgccccattttcttctctcttgctccca

SEQ ID NO: 114574 - DNA, 201 bp, Bos taurus
gttccatttccttccttactacttctcttcctttctgtgtttacacctccttttggaaaatgcctctttccctaaacacacttgaaaaactcattttctcrgtgagttaggggaaattttattgggctggccaaaaagttcccttgggtttttctctaagacgttttgggaaaacccaagcaaactctttgaccaacccaa

SEQ ID NO: 114575 - DNA, 201 bp, Bos taurus; identical to SEQ ID NO: 33644

SEQ ID NO: 114576 - DNA, 201 bp, Bos taurus; identical to SEQ ID NO: 33645

SEQ ID NO: 114577 - DNA, 201 bp, Bos taurus; identical to SEQ ID NO: 73197

SEQ ID NO: 114578 - DNA, 201 bp, Bos taurus
gaaggcagagcagacagtaatggggtcctcaaagaggtagggacacaacaccaggcacagagatagaaagtggcggccagcaacagagtgcagtgggatcrttagtagctccctgtggtggtggcagtggtggtgatgatggtggtagactggccttgaaggaaggggaacattttgaaaaagtggaggtggcaggaaaga

SEQ ID NO: 114579 - DNA, 201 bp, Bos taurus; identical to SEQ ID NO: 33646

SEQ ID NO: 114580 - DNA, 201 bp, Bos taurus
aacagatctgggcaagtcacatggtctccaagggcctgagctggctcatccataaagtgagtaccgttcccttatctcatcatgctactggagaacaggayataaagaaagtacagggcctagccctgggcttcccagatggtgccaatggtaaaaacccgcctgccaatgcaggagacataagggatgtgagttcagatc

SEQ ID NO: 114581 - DNA, 201 bp, Bos taurus
aagtaggacacgaccgagctactgaacaacaacaaatcaaagagcagtcacaacatcctacaagaaaagtggactgatttttaatgggccaaaaaaattcytgagccagactaaaggttagcggctggactgggctggaagaaggctgagtatgatcaattctggccatccttttcaaactctagacttgtgggtttggga

SEQ ID NO: 114582 - DNA, 201 bp, Bos taurus; identical to SEQ ID NO: 33651

SEQ ID NO: 114583 - DNA, 201 bp, Bos taurus; identical to SEQ ID NO: 33652

SEQ ID NO: 114584 - DNA, 201 bp, Bos taurus
tttaagttgctttactgtccaggcctattcttgtactgattaaaaatttccattgtctataacataaagatatttggctggtcttagaattacctggagcrtcattcccattgtggggcccactggtgagaaagaacaggtcatgcatattcagagatctaacaccagagctgagcccagggcccttgtggggaaagagct

SEQ ID NO: 114585 - DNA, 201 bp, Bos taurus
tgaggactggtgtgacccagttgtggttatattaagagaagagactgatgaaaggaagagaggaagcaatcagaaagaaggtccatttgactcgcttaacrggagacagcaatgtagcacttttacaagagagagtttgttgtaaacagagctgctaagtcgcttcagtcgtgtccgactctgtgcgaccccgtagacggc

SEQ ID NO: 114586 - DNA, 201 bp, Bos taurus; identical to SEQ ID NO: 73205

SEQ ID NO: 114587 - DNA, 201 bp, Bos taurus; identical to SEQ ID NO: 33655

SEQ ID NO: 114588 - DNA, 201 bp, Bos taurus
tttgagttaggaggggaaaatgcacataaagagaatttaaaatggtaccaaagtaagatttacaatacaggttgagaaatcaagccaaattctgtattttyatttaattccaaactgtaatgtttcaaaatttaacgagtgaggtagaaatccacttttacagcttagaagtataaaaatatgggataaacaaacatccct

SEQ ID NO: 114589 - DNA, 201 bp, Bos taurus
atgaactcaaaattaagcattcatttttaagccaaggtgaggacagtagctctatttcagcaatacagagaaggctttcagcattccaaacaaagaaaggkagcaggaagactgagttctcctacagaccacagcctgcaagcatcttaacctgctgaaattacctaggtggcccactcataaggtgctttactctggaac

SEQ ID NO: 114590 - DNA, 201 bp, Bos taurus
tcattataaaactcactgccagtaccactggcagcttctcactcttccagggagtacttgaaagtttatttgtggaaggggactaaagctggccaatttcrcgcaaaagcccatccatgcaggcagtggctaagctggagagagatttggcagtcagcaggggtggtacctgctctaggccctttgcctctgctgtgcctg

SEQ ID NO: 114591 - DNA, 201 bp, Bos taurus
agaaagcacagaggccatggccacagcctggaagcatggggcagcagagccacggtcagtaaagaacaaaagacaacacatggacaagaacatttcctccrggccaaaaaaagtcatcaggaatttggattgcattgaaaacaccaaattcagaattaaccatatttaaaactttaagtgactgagttagcttgaagcagt

SEQ ID NO: 114592 - DNA, 201 bp, Bos taurus; identical to SEQ ID NO: 73211

SEQ ID NO: 114593 - DNA, 201 bp, Bos taurus; identical to SEQ ID NO: 73212

SEQ ID NO: 114594 - DNA, 201 bp, Bos taurus; identical to SEQ ID NO: 73213

SEQ ID NO: 114595 - DNA, 201 bp, Bos taurus
gtcaacttttataacaatatattcatgtaaattttacataatttaaaaagtgatataattttaaaatattctgttcttccagaggaactctaggatacacyctcaaatattaagaacaataaagtctggggcaagggcttcaggcagaagggcaaagaactttttttttacacacctttgaatttttgtaaaatgtatcac

SEQ ID NO: 114596 - DNA, 201 bp, Bos taurus
tccattaaaaaaaacctcaaaaacagctattcattttctttttctaattacttggcagaaatttagaattgaaagagacaaacaagtaacaaccaaacttygcttgaacaaaagggattcttgggtcctggagaccagagaaatgagcaggaatgctcagggtgagtttgggtggattgcagaatggattgcagaacctgg

SEQ ID NO: 114597 - DNA, 201 bp, Bos taurus
ttaactaaaatattagtaataacttgataatagtttaatgttgaatgttatatttttgtatatttttgaaagcaaaatttagcttttattctttgttccargggtgagtttctgctgctgaagagtagatctgaaatttcatgtgtactttaagaaaattgttgccttatggggcccattttcaggatcaaatccagtcac

SEQ ID NO: 114598 - DNA, 201 bp, Bos taurus
tttgataggaaatattctaagagtaatttttccccagttcttcttttgtaccctagggagagttactgtagcccaactcactgggcccccctccccgctcycctgtgtgtcatcgtggggtgggatcagcatcgttctgtgtgtgacacgacacagatgcggcgtctctgcgtttctccatggcccatttcctgctcactc

SEQ ID NO: 114599 - DNA, 201 bp, Bos taurus
gtagatacggattcagatactgactatcagttattgatgcaggaccctggataacctatgaactgcctatctcattcctctgaaagcattttattagatgyaaagcaccaaagagatattaagtaatagtatgatcttacaacagaagtgacaggtgtgtcctattttgtctctagatatgctctttctaatactgcattc

SEQ ID NO: 114600 - DNA, 201 bp, Bos taurus
gcactgacagcagcagtcctacaaggggccccttggaataagtcctcttgtaggtcaccactaacactaccatagagcctgtagaccccagggttgagtcwccttaggccagacaactaacagggagagagcacaaccccatccgtcatcaaataatttgattaaagctttattgagtaaggccctgcccaccagagcaag

SEQ ID NO: 114601 - DNA, 201 bp, Bos taurus; identical to SEQ ID NO: 33657

SEQ ID NO: 114602 - DNA, 201 bp, Bos taurus
ggtagttatagattacttctgttccctagcttactgcattggatagaattctcagaacaatttgaataaaagaggtggtagtagtcaggtatggatgtgasagttggactgtgaagaaagttgagcgccaaagaattgatgcttttgaattgtggtgttgaagactcttgagagtcccttagacagcaaggagatccaacc

SEQ ID NO: 114603 - DNA, 201 bp, Bos taurus
gggtcattggtttcccatgctgctaaagggtgaaatgatgacttctgtaaatattgggctaattttgctcatttccatcaggtcactgtcctcgatccctrtgccttggtcctcgtgcatgtattagtcattgaggtttttattgcaaagtattattggactttcaatgcaaattcagcagtgccctttctatctgctgag

SEQ ID NO: 114604 - DNA, 201 bp, Bos taurus; identical to SEQ ID NO: 33664

SEQ ID NO: 114605 - DNA, 201 bp, Bos taurus; identical to SEQ ID NO: 33665

SEQ ID NO: 114606 - DNA, 201 bp, Bos taurus; identical to SEQ ID NO: 33667

SEQ ID NO: 114607 - DNA, 201 bp, Bos taurus; identical to SEQ ID NO: 73232

SEQ ID NO: 114608 - DNA, 201 bp, Bos taurus; identical to SEQ ID NO: 73233

SEQ ID NO: 114609 - DNA, 201 bp, Bos taurus; identical to SEQ ID NO: 33668

SEQ ID NO: 114610 - DNA, 201 bp, Bos taurus; identical to SEQ ID NO: 33669

SEQ ID NO: 114611 - DNA, 201 bp, Bos taurus; identical to SEQ ID NO: 73236

SEQ ID NO: 114612 - DNA, 201 bp, Bos taurus
gcaagtcatttaacttttctgaacctcaatttcagaatcattaaaatgataatatatatgcttagcattgttgttataaagatcagataagatttacagargaacattcttttaagtattgtaaagtatcacataagtatttggcctgttgttatatgtttaatgagtattcattaaataaatactggacacacaggaaac

SEQ ID NO: 114613 - DNA, 201 bp, Bos taurus; identical to SEQ ID NO: 73238

SEQ ID NO: 114614 - DNA, 201 bp, Bos taurus; identical to SEQ ID NO: 73239

SEQ ID NO: 114615 - DNA, 201 bp, Bos taurus
agtctattcagggctccttcctgcctcatgaggggcctcacacagcagcagatattctagcctattctcacaagctctgtctattgctttccttcgtggayattcccttaggcctagtgccaggtacatcccatcctcctgagagaaggacctgaaaaagaggccagcacaggcctgccacagggaatcctggggaagaaa

SEQ ID NO: 114616 - DNA, 201 bp, Bos taurus
gacactccagttctgaactaaggtcccaggaggccttgcaggtttctactcatcctcttcaacccttgcttttgccatgagagagactgccatggtagagyagagttcagtcttgtagcttaggccatcttagagcattaagcctccaactaacctgtgagcggaatgctgacgcaggaacaaaactcagctgagatcaga

SEQ ID NO: 114617 - DNA, 201 bp, Bos taurus; identical to SEQ ID NO: 73246

SEQ ID NO: 114618 - DNA, 201 bp, Bos taurus
atatattatgtgaaggagtgctttttatttcatttctgttttttaatttaactgagtcaactttaggcattagattttattttggccacacactatagagrcttctttgaaattagccttatctgcctggttttacttagagactctgcttcagaatctaaactatgaagactcaggcctttgccagaaaccaatatagac

SEQ ID NO: 114619 - DNA, 201 bp, Bos taurus
aagctgaaagaggatagtgtaaaagctggcttaaaactcaaaactcaactcagtccatggggttgcaaagagctggatacaactgagcacctgaacaagaygaccattctagttggccttgtcttctgtcctaggtgtacaatgcccatgagtagggctgtgtgttctgagcttatttcctagtttccttcctaaccttag

SEQ ID NO: 114620 - DNA, 201 bp, Bos taurus
tcgatatttgttgacccggatgtgctgtgtgactctctattactgttttagatgaaaatacgtaatgagcacaagtttttaggatctaacaaggaggcacracaagacaaatgctgcaatgtgttctattctcaggacacccgctctagtctaatcaccccaatcatcttccttggcatcagctcaatggtctttgccaat

SEQ ID NO: 114621 - DNA, 201 bp, Bos taurus
gtcactagaggctgcatctgaaaagtattctgaaaaggaggacaaatacgaagaaattaaacttctctccggcaaactgaaagaggctgagacccgtgccraatttgcagagagaacagttgcaaaactggaaaagacaattgatgacctggaagaaaaactggcccaggccaaagaagagaatgtgggcttacatcagac

SEQ ID NO: 114622 - DNA, 201 bp, Bos taurus
gaatttgatgttgtctgttcaatactgcccagtgtaatttttgctttgagaatactcaaataatctggcttaaaattttttattataaaatatgtgcatartaacacatgcccagagtgaaaatcacttggataaacttttgcataaataattatacttgtattgccatacttataaggaaaaacaaaagaaaaagcatgg

SEQ ID NO: 114623 - DNA, 201 bp, Bos taurus
gattaacaactgttggaatctgccctttggaactcagagaaagtcatagatgctggagacttgcctcctaaaaatgggggacaagaaaaaggccaccattyctgggactccacaggacctaactcagtttgactctttagatcagatcagatcagatcagtcactcagtcgtgtccgactctttgtgaccccatgaatcgc

SEQ ID NO: 114624 - DNA, 201 bp, Bos taurus
tttttcttttggtcaccttgatgtgtgccatttcataagtgtttgatactctcttctctgatatacctacctgatatcgagttcttctcctttgagtgctyctccttttctgtatctattgccatttctccaggcaaacagctacttaagctgttgggagcaacgtttttgttactaggctgcctcctctgagagctctaa

SEQ ID NO: 114625 - DNA, 201 bp, Bos taurus; identical to SEQ ID NO: 73250

SEQ ID NO: 114626 - DNA, 201 bp, Bos taurus; identical to SEQ ID NO: 73251

SEQ ID NO: 114627 - DNA, 201 bp, Bos taurus; identical to SEQ ID NO: 73252

SEQ ID NO: 114628 - DNA, 201 bp, Bos taurus; identical to SEQ ID NO: 73253

SEQ ID NO: 114629 - DNA, 201 bp, Bos taurus
tgtactatctagatgcagtgcttcctgaaagagtgtcctgatgaagttaaaactgatggtccatcttggaaggattctgcaacacttaggtgccatcctcyaaggcatagtatatgcactgaatcacatatcattattttgtcttcagcaggaaaactgtatgggtccagaaaactgagttcacctcacttactatcactg

SEQ ID NO: 114630 - DNA, 201 bp, Bos taurus
accataaattttggattttaaaaatacagaaatgtattccctcatagttttaaaagtcataagtctaaaatcagtatctcttggccaaaatcatggggttkccagagccacgtgtcctccagaaggtctatgcaagaacccatttttaacctcttccagatgttgatgactgccatcattctttggcttgtcattgtataa

SEQ ID NO: 114631 - DNA, 201 bp, Bos taurus
tggaaagaaaactgtccttttccattcatgtggccacagctgagttttccaaatttgcaggcatattgagtgcagcattttcacagcaccatctttcaggrtttgaaatagagaaggcctattgagagaagaatttgaggaaatataggagtgagctgaaactgtaagctgtgggaatgctgagaaagttgaataatgtat

SEQ ID NO: 114632 - DNA, 201 bp, Bos taurus; identical to SEQ ID NO: 73258

SEQ ID NO: 114633 - DNA, 201 bp, Bos taurus
aagagaaggaaaagagagttttctttctcttcctgctctggggaaagctcctgtgaggacacagtgagaaggtggctgtctgcaagtcaggaagagagccytcatcagaaatcagtcatgctggccctgtgatcttggacttctggcctccagaagtgaatttccattgtttaagccacttcatctatagtattttgtcat

SEQ ID NO: 114634 - DNA, 201 bp, Bos taurus
tcaaaagggatggctgcttaagggtggctaggaaactaaatctgtgaatattgaccatgtagaacagtacagcagttatgtatgatataaaatgccttgtrgaactagtataaagaaactgaagtgtacatcatgaaccaaattgggcagtaaggtctgttataatttatcatcatctccttaaaacggctcattaaaaaa

SEQ ID NO: 114635 - DNA, 201 bp, Bos taurus; identical to SEQ ID NO: 73261

SEQ ID NO: 114636 - DNA, 201 bp, Bos taurus; identical to SEQ ID NO: 73262

SEQ ID NO: 114637 - DNA, 201 bp, Bos taurus; identical to SEQ ID NO: 73266

SEQ ID NO: 114638 - DNA, 201 bp, Bos taurus; identical to SEQ ID NO: 73269

SEQ ID NO: 114639 - DNA, 201 bp, Bos taurus
actggatgtttctctctggaatagattctgaactgggcccctcaattacagtaccggtatccttagggcaggcaaaatggaaatgtcctctaaagatggasaaatataataatacaaagtgaaaacagcaaacaatgaaacaaagtttattattaaaggtctgatatttcttcagacaaggtctacttaaaagctgagtac

SEQ ID NO: 114640 - DNA, 201 bp, Bos taurus
atagagactaaactgaagtctgagagggagactgataggcaaaggtttaaaatatatttttggcttcatttggtgaggcctcattttgtttagctaagtawaatgattcagatccttgagctccaggagtaaatgggtttaaatattttttaattttttaaaatatgtttttggcctcattttgtgaggcctcattttgtt

SEQ ID NO: 114641 - DNA, 201 bp, Bos taurus
ttcatggaaagaacaacattgttggagatttcagtgataaattgctaggagtttttgttgacaaatatgttagtacttctttttttcctttgagatatackagtgttttatttgttcagtatgtaaatgacacaaattgataagaagcaaaaggaagaaatgttaaccttgtgtatgttaacttaagagctcatgtagaca

SEQ ID NO: 114642 - DNA, 201 bp, Bos taurus
taccagcacaccacagtatttgtgatcaagccataggaaggccaggaggtagccctgaccaccagtgtgcccacagtggtcatgatggacctcagagccarcagtctgagggcccaaccttgtatttcattgaacctgcagcaatcatgacaaaacattaaaaagacaaagacaaaaaaaagataaaacctttaaaaaaat

SEQ ID NO: 114643 - DNA, 201 bp, Bos taurus
gttataaaacaactgaagggaagaagacagtaaaaccaaaatgtttaagtactcacacagtggctctttcaatagagatttttgctagttcctaagcatcmagtcatgtaaactctaccaagatattttgcagctgattatacagttataagtacctttttcagtgattgcaccaaaagtcctaatatgtactctctggat

SEQ ID NO: 114644 - DNA, 201 bp, Bos taurus
ttctttttgtattgtctcttttccttctattgaaaacagggccaggccttgccttgttcataccatgtaacccatactttggaaagaaacatgagtagatygaatgaaaatattttcttgcttataacctatattcttaagatccagtaaaatatatatggaatttatgtatcatgagaagatgggcaaatcaggagttca

SEQ ID NO: 114645 - DNA, 201 bp, Bos taurus; identical to SEQ ID NO: 73271

SEQ ID NO: 114646 - DNA, 201 bp, Bos taurus; identical to SEQ ID NO: 73272

SEQ ID NO: 114647 - DNA, 201 bp, Bos taurus
tctaccatgtgcctgaaaagaagagaagaagaagtaccaataaaaggccaagagactaacacaatgggtataatcttgttttccatttctacctaaatacrtatcaaactgattataagccaatttctcatacatttagcttgttctacaaatatttaacaagtactattgtatactaagtttttacaaaatggtaaggcc

SEQ ID NO: 114648 - DNA, 201 bp, Bos taurus
gataccacaggagattttatgagaaaggtttaatcatacggtacatataaatatttgctataattcattatgcataatagagtgcattttatagcctaccrtttccagtaaaaatatagcaaagccatgaggttgtgaatggttttccagagggaatgatgtcagatattcaaggatgtatacattcaacacatatttatt

SEQ ID NO: 114649 - DNA, 201 bp, Bos taurus; identical to SEQ ID NO: 73277

SEQ ID NO: 114650 - DNA, 201 bp, Bos taurus; identical to SEQ ID NO: 73278

SEQ ID NO: 114651 - DNA, 201 bp, Bos taurus
acacacagaacattaggactgaagcagtgactattccatttctgagaactgttgagaatgatatggcttcattctgctctatatggagaaagagttgtgtrttcatggggaggagtgggcataagacatccaatttagactctcttgaaaagcctgaagtattgagctagtcatcactgcagtatacttcacatgctaggt

SEQ ID NO: 114652 - DNA, 201 bp, Bos taurus; identical to SEQ ID NO: 73280

SEQ ID NO: 114653 - DNA, 201 bp, Bos taurus; identical to SEQ ID NO: 73281

SEQ ID NO: 114654 - DNA, 201 bp, Bos taurus; identical to SEQ ID NO: 73282

SEQ ID NO: 114655 - DNA, 201 bp, Bos taurus; identical to SEQ ID NO: 73283

SEQ ID NO: 114656 - DNA, 201 bp, Bos taurus; identical to SEQ ID NO: 73284

SEQ ID NO: 114657 - DNA, 201 bp, Bos taurus; identical to SEQ ID NO: 73285

SEQ ID NO: 114658 - DNA, 201 bp, Bos taurus; identical to SEQ ID NO: 73286

SEQ ID NO: 114659 - DNA, 201 bp, Bos taurus; identical to SEQ ID NO: 73287

SEQ ID NO: 114660 - DNA, 201 bp, Bos taurus; identical to SEQ ID NO: 73288

SEQ ID NO: 114661 - DNA, 201 bp, Bos taurus; identical to SEQ ID NO: 73289

SEQ ID NO: 114662 - DNA, 201 bp, Bos taurus; identical to SEQ ID NO: 73290

SEQ ID NO: 114663 - DNA, 201 bp, Bos taurus; identical to SEQ ID NO: 73291

SEQ ID NO: 114664 - DNA, 201 bp, Bos taurus; identical to SEQ ID NO: 73292

SEQ ID NO: 114665 - DNA, 201 bp, Bos taurus; identical to SEQ ID NO: 73293

SEQ ID NO: 114666 - DNA, 201 bp, Bos taurus; identical to SEQ ID NO: 73294

SEQ ID NO: 114667 - DNA, 201 bp, Bos taurus; identical to SEQ ID NO: 73295

SEQ ID NO: 114668 - DNA, 201 bp, Bos taurus; identical to SEQ ID NO: 73296

SEQ ID NO: 114669 - DNA, 201 bp, Bos taurus; identical to SEQ ID NO: 73297

SEQ ID NO: 114670 - DNA, 201 bp, Bos taurus; identical to SEQ ID NO: 73298

SEQ ID NO: 114671 - DNA, 201 bp, Bos taurus; identical to SEQ ID NO: 73299

SEQ ID NO: 114672 - DNA, 201 bp, Bos taurus; identical to SEQ ID NO: 73301

SEQ ID NO: 114673 - DNA, 201 bp, Bos taurus
catctcctgcattggcaggcaaattctctaccactagcatcactgtgggagaatgtcaaatattttaacatttacgtaattaagtcttataagaagaaagytgagtctcaaaaaaatgtgtctgataaacttaaaatggctgaaattttcccatatttagtgaaaacataagcttatggattcaagaatgccaacaaattc

SEQ ID NO: 114674 - DNA, 201 bp, Bos taurus; identical to SEQ ID NO: 73302

SEQ ID NO: 114675 - DNA, 201 bp, Bos taurus; identical to SEQ ID NO: 73303

SEQ ID NO: 114676 - DNA, 201 bp, Bos taurus; identical to SEQ ID NO: 73304

SEQ ID NO: 114677 - DNA, 201 bp, Bos taurus
tatgcagtcttctactagtctggcccagcagatccagcatcactccagcagactgatcataggactgaccatagttcactaaacaagcaactccctgaagrtttcaatcaactggcaattggtgaagagaaaatgtccatgttggagagcccagaaatacaggccacatgttcccctccaccatttaccaggccttgtctc

SEQ ID NO: 114678 - DNA, 201 bp, Bos taurus
ctgataaatgtgtgttagaaattactccacagaagaacacacagttctttctcatttccctttacagcttcctttgtatggatgggccattttattcaacwatccacaacaatttccagtgttttgctatgacaacactgtagcatttttacggggcccactgcgtaaaagaatacaaacaacttcagtattcttgccttg

SEQ ID NO: 114679 - DNA, 201 bp, Bos taurus
taggtattcagaataatactccaatctattcccttacctgcatcactattcaagcccttataatttctcactttcattatataagtatagcctttctaatytcaagccattctctactagacttggcgtgatctctccaataaaaatgataattttacttattcacagagtcttgagaacttttaaagtgcaaactttgta

SEQ ID NO: 114680 - DNA, 201 bp, Bos taurus
gctacaaaaaagtgtgaagtactaatacatgccatagcatggatgaaccttgaaaactttaagctcagtgaaagaatccagacacaaaaggccacatactrtatgactccattcacatgaaaggtccagaataagcaagagacagaaagcagattagtggctgccaaaggatggggtgagtgatagggactgactgataat

SEQ ID NO: 114681 - DNA, 201 bp, Bos taurus
tcttggagcctgtacatcccatcacatgcatgattcggaaggaaggagacttcaggctccacagtttgaccagcaaccaaaccaagtggcctgctgactcmgtgactttattggtagtaacccaattatcagcccagggtatttctgaactgtccttaagagtttgtattctgaattggggtctggagcactaggtaagag

SEQ ID NO: 114682 - DNA, 201 bp, Bos taurus
caaacacagagagtgatatggattatatccattccatagatatccaggccatttggctcttaggttgcatttatgtgtgaggatcttccctagttcagaaytgctgctttgcctctttttgaggccttagaattgttcacagcagggtttgaacttaggtgccagtctagtgtaggtttttcccccttaaacaaactttga

SEQ ID NO: 114683 - DNA, 201 bp, Bos taurus; identical to SEQ ID NO: 73310

SEQ ID NO: 114684 - DNA, 201 bp, Bos taurus; identical to SEQ ID NO: 73311

SEQ ID NO: 114685 - DNA, 201 bp, Bos taurus
gtttacttctctgtgagtaaaacttgtcttcattggtaatgtgtaaacttctttctaaagtcagaatgttctgacccattgttcttcctttttgagaattyagcacagttcttcacatgttgtaaagatacgtaagtactggatggagtcatggaagaagagggaaggaggcaagagaagtcgtgattgttttcaaaatgt

SEQ ID NO: 114686 - DNA, 201 bp, Bos taurus; identical to SEQ ID NO: 73313

SEQ ID NO: 114687 - DNA, 201 bp, Bos taurus
atttaaaagtagaatgtaaggggagagactgaaggaacttgacatgtttgttgataagtggaaaatgggtctgtgggcagtggagaaaggaaagtaccttrgttagatatgaaacaagatataacacatgctaaggatccaaaaaaagtagaacagagtcaactagcctccttaatttgttcatggtagggcaatgccgaa

SEQ ID NO: 114688 - DNA, 201 bp, Bos taurus; identical to SEQ ID NO: 73314

SEQ ID NO: 114689 - DNA, 201 bp, Bos taurus
atcagtgaacacacacataaacatacataaatatgtacacaaattagttttttaaaaattcagctgccatagtctcacgttgttataaattgctaatatcktctctactgcaccaactgacagttggtgtcctgactaaagattgattaaaagtgacattgtcatggaaaatttcaacatgtaaattctctactgatttat

SEQ ID NO: 114690 - DNA, 201 bp, Bos taurus; identical to SEQ ID NO: 73316

SEQ ID NO: 114691 - DNA, 201 bp, Bos taurus; identical to SEQ ID NO: 73317

SEQ ID NO: 114692 - DNA, 201 bp, Bos taurus; identical to SEQ ID NO: 73318

SEQ ID NO: 114693 - DNA, 201 bp, Bos taurus; identical to SEQ ID NO: 73319

SEQ ID NO: 114694 - DNA, 201 bp, Bos taurus; identical to SEQ ID NO: 73320

SEQ ID NO: 114695 - DNA, 201 bp, Bos taurus
agactctctgggtccagttttcttgcatcttttaaatataaatttcataatgcaacagattattgcctaatggcttttctgtgcgccaagatgaaagtatyaattttgtttagtctgtagttaaaaagtagaatttggggttttggtgttattactgttagaggtactgtacagtcacaccccacattttaagttctgatt

SEQ ID NO: 114696 - DNA, 201 bp, Bos taurus; identical to SEQ ID NO: 73323

SEQ ID NO: 114697 - DNA, 201 bp, Bos taurus
cagtcaactattttcatcatctgtgtgctaaataccactcagtgtgggacaagcactatggtgagacagtaggttatccttactggagcaggatgctctcygcacacagcaggccagaccctgattagctaagacctaatatcaggtaaaaccctgagataagatagtaagaaactccacactcattttgggcagtaacta

SEQ ID NO: 114698 - DNA, 201 bp, Bos taurus
tgctcaggttttgaaagtgaaacagctaccttcctatctgctatgcaatctgatgagtttaatttttttttaagaagagatttgagtgagctcagaggccraaagaagaaaaggagatttgatgactggagaagctgactgctcactgatttacccctggaatctgaaagttcttaatgttgaggtccttatcttggccat

SEQ ID NO: 114699 - DNA, 201 bp, Bos taurus; identical to SEQ ID NO: 73327

SEQ ID NO: 114700 - DNA, 201 bp, Bos taurus; identical to SEQ ID NO: 73328

SEQ ID NO: 114701 - DNA, 201 bp, Bos taurus
ctctaaaaatcatgctttttctcttcatgacttttgaaaatgatcaataaatctaatgaatagacagtgccatggctgcatgcttatctcatcttattccyatatattttgataattttgtatggattgctgtttactgccatcctttgggtcacagtaaatattttaatcattatttcctctgtaattttctttaatgaa

SEQ ID NO: 114702 - DNA, 201 bp, Bos taurus; identical to SEQ ID NO: 73332

SEQ ID NO: 114703 - DNA, 201 bp, Bos taurus; identical to SEQ ID NO: 73336

SEQ ID NO: 114704 - DNA, 201 bp, Bos taurus
ggccctcctctaatccatcatccatactgcagccagagcaattgaagtggctggaaaggaccctaggtgtgctggctggatccttacctctcacacccagrcaggcccttcaggaagcagacacattttggcccctggggctctccagatctgtagctttagaactcttgcacaagtctgaggacttgctcttccaaacaa

SEQ ID NO: 114705 - DNA, 201 bp, Bos taurus
aggcacattaggtaggaaaaatgggaccagctttcgctgtcatttaggctgtggtttttttcctagcctatatcagcctatatcaggctcccagatgagcraagtatagtagaagctgcattttcctttcatttttgctgaagaaaggtggatgattttgtcagtgaggaagtagatcaagtgccagcagccctctgagac

SEQ ID NO: 114706 - DNA, 201 bp, Bos taurus
tggcacagacaaagccagccgtctttagaatgggaaaaatgaacaaaattcaacaattttaaagcgtgatttccctaattgggtggtccagaagccaaatkttctcctcacccctgaatatagaatccgaactgtagcctcaaaaatacttttctctagaaagtacgtcattgttcagtcactaagtcatgtctgactctg

SEQ ID NO: 114707 - DNA, 201 bp, Bos taurus; identical to SEQ ID NO: 73338

SEQ ID NO: 114708 - DNA, 201 bp, Bos taurus; identical to SEQ ID NO: 73341

SEQ ID NO: 114709 - DNA, 201 bp, Bos taurus; identical to SEQ ID NO: 73342

SEQ ID NO: 114710 - DNA, 201 bp, Bos taurus
ccactgtgtttgggggacgagctcaagaggtagtaacagtgtgtgttaacttgccgtgtacttggtcgttaaaggagggccctaggcccgcactgggttcmcggagccaaacaaactgctaggcagaatttaattcttgagaacatgaagccatcatgtggatgagcttggagatgtctacccggctctgccactggccct

SEQ ID NO: 114711 - DNA, 201 bp, Bos taurus
actcgttgatcccttagagatagtggactacctgctggactacatgtctgaccatactgtagctgaatttgccttctagcacctgcccagcacaggttagwgggtcctgggccttctcaacaagccatggtacactcaatacttgcatgtttcaaggccactgccattgctcaaaacactttggccactcctttacaggaa

SEQ ID NO: 114712 - DNA, 201 bp, Bos taurus
catctccaggtaccctttcctggagttggaatttcctaagccatctgactgaaatcaaattcaggttcgcaacaggccacataaatagtatcggtcaaagraagagtgtcaaaatgcattttcccctcacccggtctgcagtttcctcatcttgggataatatgttagcatggccacagttattattcttgctgcaagcaa

SEQ ID NO: 114713 - DNA, 201 bp, Bos taurus
ccaggacacagggaacacaaggtggtggacagttccactgaatcccccgtcactgaggagaagacaggcaccccagatgcactgcccatctggccagcctytctcctgtgcttcgtggggagatacatcattacttaatattcagaaaccaccctctcccaaataggactcaaggcctagctacagcaatacataacctgt

SEQ ID NO: 114714 - DNA, 201 bp, Bos taurus; identical to SEQ ID NO: 73349

SEQ ID NO: 114715 - DNA, 201 bp, Bos taurus; identical to SEQ ID NO: 73350

SEQ ID NO: 114716 - DNA, 201 bp, Bos taurus; identical to SEQ ID NO: 73351

SEQ ID NO: 114717 - DNA, 201 bp, Bos taurus; identical to SEQ ID NO: 73353

SEQ ID NO: 114718 - DNA, 201 bp, Bos taurus; identical to SEQ ID NO: 73355

SEQ ID NO: 114719 - DNA, 201 bp, Bos taurus; identical to SEQ ID NO: 33675

SEQ ID NO: 114720 - DNA, 201 bp, Bos taurus
atattcccttcaggccaccagagctgtatgctccaagggtgctctctatgtggctctaggagctcttctgttagggtgggctgactactgtgggtatgctrgtaggcttggctggcttctggcctggttggttgccaagccctgcctaatgtggctgttggaaagtgtggagggtcttgacacagttgtctgcattgcctg

SEQ ID NO: 114721 - DNA, 201 bp, Bos taurus
ctggacctcctgccgcctggtgcaatacatttgcatcttgaactgaacttccttcctttctctgcagctgcaacctgagaagctcaggttgggcccaatcrtcattgctttttgtctgtgtccttctatcctacatcagggaaaggtatgtttcactgaagcatctggcctctttcgtttctttttggacagttgcaggca

SEQ ID NO: 114722 - DNA, 201 bp, Bos taurus
agatgctgcaagtatagcccccaaatgaaagccagaaaatacagagagaattacgggtcactccttagtattctcagattctggccttatcccaagatttyacttcctttgccgatggtttatgtgctacaaagaataccttgttaataatttgattcatttaattctcagtgggagtcttttatcatatcagaatcacct

SEQ ID NO: 114723 - DNA, 201 bp, Bos taurus
tgttttagaaaaataattacacgtcttcagaagcaatttagactaatttgaattaggtctaaatctcagcacttacataggtaggtgaaatacaacgaagyttaccttctgtccccttcctacccaccttttcctttcttagaccgagcctggctgatagaaccaaggaaggtccagaagcttcaggaaaaaatttatttt

SEQ ID NO: 114724 - DNA, 201 bp, Bos taurus; identical to SEQ ID NO: 33680

SEQ ID NO: 114725 - DNA, 201 bp, Bos taurus; identical to SEQ ID NO: 33681

SEQ ID NO: 114726 - DNA, 201 bp, Bos taurus; identical to SEQ ID NO: 33682

SEQ ID NO: 114727 - DNA, 201 bp, Bos taurus; identical to SEQ ID NO: 33683

SEQ ID NO: 114728 - DNA, 201 bp, Bos taurus
tacagatttgacccctgtgtgtctattgggtaagtaggaagtgagtcctttaactctgttctatgtctctagagattctctaatcattttcttaaatatartgtatatctttgtccctatatcagattttaaggggttctgctttaaataaaagaaaacattttatcatcatgttatggtgctagcttttgtttttataga

SEQ ID NO: 114729 - DNA, 201 bp, Bos taurus
gagggctccacaattttgtaaggtgccatcactttgaatgaattaagagattacttatttaattgaaggagtctgtttagtcagtctattaagtaagtgtmgtatactaataaaatgggactgaacctggagtttaactgtgaaattaatttatccttgttatgcatgactctcattggcctagataactaagaattacac

SEQ ID NO: 114730 - DNA, 201 bp, Bos taurus
aagagtcaaagacacacaaaggcatatatattcctaaccccatattataatatcctctgtattttcctgttctcatgtttcatcaaagaaaccttaatttycccttccttagaatttctaaaatgtcacatttcctcttttaccttccacatttgtgtaacaaggcaggagtgtactctagaaatctcaatgcccccaaga

SEQ ID NO: 114731 - DNA, 201 bp, Bos taurus
tctcaagaattttcatcaaatataataataactttcatttttacaactttgatcagtaaaagaaatgaaaaccttaagtttctgtgtctgctatccatatyctcagttcctcctagaaaagacttgttcattgattggatgttggaggggggtaatctggtgaggaaaagtcagatagataatagatgatagagtcttctc

SEQ ID NO: 114732 - DNA, 201 bp, Bos taurus; identical to SEQ ID NO: 33685

SEQ ID NO: 114733 - DNA, 201 bp, Bos taurus
gaggctcttgttaagtatagcatttctagcccttccccttaaagtattatctagtgggcttggaaattaatgtattcaataacttgaatggttcctatcaycagagaagtctcagacctgatgttagaggaacttttgaaggcaagtgtggctgaagcctaaaggttacggggttgttggatgagagcaggacatgtccat

SEQ ID NO: 114734 - DNA, 201 bp, Bos taurus
ctggagctctgtaactgtctgaccatgaatctcgatcaccacgtgtcacctgccatgattctctctgctgcccagactgtcagaccactcctgtagtgttyctgacttgctcttcacctctgcacctcatgtctccagctgacgggtgaaactgcttgctgccttatgtcttgctgtttggaaagtaagagaagggggtct

SEQ ID NO: 114735 - DNA, 201 bp, Bos taurus
caatataagaaagatggagactccatggagacttggaggaaaaaatggggtcccaatacagggaaaactgaattctcccagaaatgagatagcatgcgagkactgtctggggttcagccattctttcatttactttctccaggtataattttgagagcttatcttgtgcaaaatactgggctagacaccagagctttttcc

SEQ ID NO: 114736 - DNA, 201 bp, Bos taurus; identical to SEQ ID NO: 73388

SEQ ID NO: 114737 - DNA, 201 bp, Bos taurus; identical to SEQ ID NO: 73389

SEQ ID NO: 114738 - DNA, 201 bp, Bos taurus; identical to SEQ ID NO: 33697

SEQ ID NO: 114739 - DNA, 201 bp, Bos taurus; identical to SEQ ID NO: 33698

SEQ ID NO: 114740 - DNA, 201 bp, Bos taurus; identical to SEQ ID NO: 33699

SEQ ID NO: 114741 - DNA, 201 bp, Bos taurus; identical to SEQ ID NO: 33700

SEQ ID NO: 114742 - DNA, 201 bp, Bos taurus; identical to SEQ ID NO: 33701

SEQ ID NO: 114743 - DNA, 201 bp, Bos taurus; identical to SEQ ID NO: 33702

SEQ ID NO: 114744 - DNA, 201 bp, Bos taurus; identical to SEQ ID NO: 33703

SEQ ID NO: 114745 - DNA, 201 bp, Bos taurus; identical to SEQ ID NO: 33704

SEQ ID NO: 114746 - DNA, 201 bp, Bos taurus; identical to SEQ ID NO: 33705

SEQ ID NO: 114747 - DNA, 201 bp, Bos taurus; identical to SEQ ID NO: 73404

SEQ ID NO: 114748 - DNA, 201 bp, Bos taurus; identical to SEQ ID NO: 33706

SEQ ID NO: 114749 - DNA, 201 bp, Bos taurus; identical to SEQ ID NO: 73405

SEQ ID NO: 114750 - DNA, 201 bp, Bos taurus; identical to SEQ ID NO: 33708

SEQ ID NO: 114751 - DNA, 201 bp, Bos taurus; identical to SEQ ID NO: 73407

SEQ ID NO: 114752 - DNA, 201 bp, Bos taurus; identical to SEQ ID NO: 33709

SEQ ID NO: 114753 - DNA, 201 bp, Bos taurus; identical to SEQ ID NO: 73408

SEQ ID NO: 114754 - DNA, 201 bp, Bos taurus; identical to SEQ ID NO: 73409

SEQ ID NO: 114755 - DNA, 201 bp, Bos taurus; identical to SEQ ID NO: 33712

SEQ ID NO: 114756 - DNA, 201 bp, Bos taurus; identical to SEQ ID NO: 33713

SEQ ID NO: 114757 - DNA, 201 bp, Bos taurus; identical to SEQ ID NO: 73411

SEQ ID NO: 114758 - DNA, 201 bp, Bos taurus
actttcacatttttctaaagtcatctttgctaggaggaaagaagaaaaagagagaggtgaagaatgagagcaaaagaaagagagggaaatagcatagtcayagtcatcatttgggatttgagctgagctgtcatggcaggagtgactcagctacaagaaggacctacccaggaccagggtacctcattttccaactgagga

SEQ ID NO: 114759 - DNA, 201 bp, Bos taurus; identical to SEQ ID NO: 33716

SEQ ID NO: 114760 - DNA, 201 bp, Bos taurus; identical to SEQ ID NO: 33717

SEQ ID NO: 114761 - DNA, 201 bp, Bos taurus; identical to SEQ ID NO: 33718

SEQ ID NO: 114762 - DNA, 201 bp, Bos taurus; identical to SEQ ID NO: 33719

SEQ ID NO: 114763 - DNA, 201 bp, Bos taurus; identical to SEQ ID NO: 33720

SEQ ID NO: 114764 - DNA, 201 bp, Bos taurus; identical to SEQ ID NO: 33721

SEQ ID NO: 114765 - DNA, 201 bp, Bos taurus; identical to SEQ ID NO: 33722

SEQ ID NO: 114766 - DNA, 201 bp, Bos taurus; identical to SEQ ID NO: 33723

SEQ ID NO: 114767 - DNA, 201 bp, Bos taurus; identical to SEQ ID NO: 33724

SEQ ID NO: 114768 - DNA, 201 bp, Bos taurus; identical to SEQ ID NO: 33725

SEQ ID NO: 114769 - DNA, 201 bp, Bos taurus; identical to SEQ ID NO: 33726

SEQ ID NO: 114770 - DNA, 201 bp, Bos taurus; identical to SEQ ID NO: 33727

SEQ ID NO: 114771 - DNA, 201 bp, Bos taurus; identical to SEQ ID NO: 73414

SEQ ID NO: 114772 - DNA, 201 bp, Bos taurus; identical to SEQ ID NO: 33728

SEQ ID NO: 114773 - DNA, 201 bp, Bos taurus; identical to SEQ ID NO: 33729

SEQ ID NO: 114774 - DNA, 201 bp, Bos taurus
gtgggcctctcaaaaagccagttcatgtgctgcacagcagagccgtcatttgggtatttattgggacagacaaaagacatttactgtctaagaaaccactraactctctggccagcaccagcagaggagttgggagacaaagcagagtgaaaaagccaggtgtgatagtcaatgtatctcagccttggtggggcacacttg

SEQ ID NO: 114775 - DNA, 201 bp, Bos taurus; identical to SEQ ID NO: 33739

SEQ ID NO: 114776 - DNA, 201 bp, Bos taurus
cttgagtgatacaaataaaaggttttgtctgtctgatttgaaaggcgttaagaatggaagtaaaaatcagaaatgaaaacatttaaaaactggcaagcacyttaacattgtaattgcctgtgcttaaagacccaagatttattatggactcaatactctaaagattttcaagtcttcagcataaccgctgggttatctaca

SEQ ID NO: 114777 - DNA, 201 bp, Bos taurus; identical to SEQ ID NO: 33740

SEQ ID NO: 114778 - DNA, 201 bp, Bos taurus; identical to SEQ ID NO: 73422

SEQ ID NO: 114779 - DNA, 201 bp, Bos taurus
gggacaaaatgaaaatacaggccctggctcaaaaattgagcatttaaagatggtggagagcagaggatgaaactaagggtgagacaggttccttttaagarcagggccagcgcagctggctcagaccacacaccatgaagctagtcctacatttctgtatcccctcttatgaataactgcagaagaaagcccaaaatttaa

SEQ ID NO: 114780 - DNA, 201 bp, Bos taurus; identical to SEQ ID NO: 33741

SEQ ID NO: 114781 - DNA, 201 bp, Bos taurus; identical to SEQ ID NO: 33742

SEQ ID NO: 114782 - DNA, 201 bp, Bos taurus; identical to SEQ ID NO: 33743

SEQ ID NO: 114783 - DNA, 201 bp, Bos taurus; identical to SEQ ID NO: 33748

SEQ ID NO: 114784 - DNA, 201 bp, Bos taurus
tgtagcagtcttctgtctctgggctttccatttatacattttcatgatgtgaacaatgcagtacaccaaaagtcgtggctcttgctatcacaagaaggcartgatgctagttgtgtttggacatttaaatcttgactgctgtcttaatcctgaagtgtcttgttatcagtgactacaaaagcacatagaatggtattttca

SEQ ID NO: 114785 - DNA, 201 bp, Bos taurus; identical to SEQ ID NO: 33752

SEQ ID NO: 114786 - DNA, 201 bp, Bos taurus; identical to SEQ ID NO: 73435

SEQ ID NO: 114787 - DNA, 201 bp, Bos taurus; identical to SEQ ID NO: 33756

SEQ ID NO: 114788 - DNA, 201 bp, Bos taurus; identical to SEQ ID NO: 73436

SEQ ID NO: 114789 - DNA, 201 bp, Bos taurus; identical to SEQ ID NO: 73438

SEQ ID NO: 114790 - DNA, 201 bp, Bos taurus; identical to SEQ ID NO: 33758

SEQ ID NO: 114791 - DNA, 201 bp, Bos taurus; identical to SEQ ID NO: 73440

SEQ ID NO: 114792 - DNA, 201 bp, Bos taurus; identical to SEQ ID NO: 33762

SEQ ID NO: 114793 - DNA, 201 bp, Bos taurus
tacaacagagaccacatggcctgcgaagcctaacatattcactagcaggtcctttacaggaaaagtgtgccaatttctgaccaggaaaatgaaaagtcatygcttcttaggcctgtggaagcttggtgacctagccctgccaacctctgaactttcttccacaccaccaccctcctgctcacactcaggtaccccactcct

SEQ ID NO: 114794 - DNA, 201 bp, Bos taurus
actggggtacacgtgtctctttcaatcctggttcgaggaatgactttcagccttgtcttctgaataaattctattctgtctgcagtggaggagcctggccytgagcacagccctgcagtgcaaagtgagaggagcacagctagttcagagcagagggggacagtcactgccccaacttcggctcaggcctccagagaccat

SEQ ID NO: 114795 - DNA, 201 bp, Bos taurus; identical to SEQ ID NO: 33765

SEQ ID NO: 114796 - DNA, 201 bp, Bos taurus; identical to SEQ ID NO: 33766

SEQ ID NO: 114797 - DNA, 201 bp, Bos taurus; identical to SEQ ID NO: 33767

SEQ ID NO: 114798 - DNA, 201 bp, Bos taurus; identical to SEQ ID NO: 33768

SEQ ID NO: 114799 - DNA, 201 bp, Bos taurus; identical to SEQ ID NO: 33769

SEQ ID NO: 114800 - DNA, 201 bp, Bos taurus; identical to SEQ ID NO: 33770

SEQ ID NO: 114801 - DNA, 201 bp, Bos taurus; identical to SEQ ID NO: 33771

SEQ ID NO: 114802 - DNA, 201 bp, Bos taurus; identical to SEQ ID NO: 33772

SEQ ID NO: 114803 - DNA, 201 bp, Bos taurus; identical to SEQ ID NO: 73454

SEQ ID NO: 114804 - DNA, 201 bp, Bos taurus
aggaataatgggagctgacaagccgatctaatgcttatatgtaaatacaaagaacacagaatagccaagataatcctgaacaaaactagagcatttacacyacccagatttaaagatttactacaaagcttcagtaattatgacagcgtggtactgaaacaaagacaaagagaccagtataatcgagtcctgtaataggtc

SEQ ID NO: 114805 - DNA, 201 bp, Bos taurus; identical to SEQ ID NO: 33780

SEQ ID NO: 114806 - DNA, 201 bp, Bos taurus; identical to SEQ ID NO: 33781

SEQ ID NO: 114807 - DNA, 201 bp, Bos taurus; identical to SEQ ID NO: 33782

SEQ ID NO: 114808 - DNA, 201 bp, Bos taurus; identical to SEQ ID NO: 33783

SEQ ID NO: 114809 - DNA, 201 bp, Bos taurus; identical to SEQ ID NO: 33789

SEQ ID NO: 114810 - DNA, 201 bp, Bos taurus; identical to SEQ ID NO: 33790

SEQ ID NO: 114811 - DNA, 201 bp, Bos taurus; identical to SEQ ID NO: 73462

SEQ ID NO: 114812 - DNA, 201 bp, Bos taurus
aggcaatggggaaggtctgatgatggtgggagcatcggccatgtgaagaggatactgagattcagaaagctcacgctgctgaccacaaggaggagggtcaygtgcagggattgtttccaggggccctggtgttgctggcgctactctcgaaggaagagtggaaattgtgaatggtttcctgtaaaatctgtctctcgcgtc

SEQ ID NO: 114813 - DNA, 201 bp, Bos taurus
gggctgggctggctgcaacactctcggaagagaaaaacagattcctcagaccctaccctgagagtctcatttagttaagctgtgtggaacccagaaatccragtttttaagtagctccccaagtttacagcatattcttatgctaggaatatcaggtgatcattgaactggattgtttctccagttttctgttgcctgaat

SEQ ID NO: 114814 - DNA, 201 bp, Bos taurus; identical to SEQ ID NO: 33793

SEQ ID NO: 114815 - DNA, 201 bp, Bos taurus; identical to SEQ ID NO: 33794

SEQ ID NO: 114816 - DNA, 201 bp, Bos taurus; identical to SEQ ID NO: 33795

SEQ ID NO: 114817 - DNA, 201 bp, Bos taurus; identical to SEQ ID NO: 33796

SEQ ID NO: 114818 - DNA, 201 bp, Bos taurus; identical to SEQ ID NO: 33797

SEQ ID NO: 114819 - DNA, 201 bp, Bos taurus
ggtctgtgggtttcatagccaggcccagcagtcctcgagcctggcaggaactggaggttctgaggttgagactgtttctcccttgtccgagggcaggcatygggcccaggcctccctgcttcatccccagacgacacccctgggagagggatgctgtctgcattgctttcagtgctcttgccccacttgccctagggacag

SEQ ID NO: 114820 - DNA, 201 bp, Bos taurus
aggcaggatgcactggggacatatatgcattggaccaagcaggccagtggggctgctcaagaaccctggtcacattccgttaccgtctcctggctccatgyggggttggaggtgaggatgggccatggaacttccagaagtatatcagagcaagaagtctacccaggtgcacctgcctgcctcatcaaccggcatggtgac

SEQ ID NO: 114821 - DNA, 201 bp, Bos taurus
agtcaggattaccccaatgtgtgctgattgcctccatttctcacgttcattcttatgaccaccagtcctgaatcctctcccttattcaaacttctgaggarggatgctactctaggaggaaattattacatgaattagcattatcttgctaacagtaagtactactgtctttgcttaatactaacaaataagatgcagatt

SEQ ID NO: 114822 - DNA, 201 bp, Bos taurus; identical to SEQ ID NO: 33801

SEQ ID NO: 114823 - DNA, 201 bp, Bos taurus
ggttggtggtggttacaaatctgccttccaacacagaggacactggttggatccctggtcagggaactgctatcccacacgccacaggccaactaagtccrtgtgctgcaaataccgagctcacgtgctctggagctctcatgctacaactaagagaggcccacacgcagaaacgaggagcctgagtgcccaactagtgcc

SEQ ID NO: 114824 - DNA, 201 bp, Bos taurus; identical to SEQ ID NO: 33802

SEQ ID NO: 114825 - DNA, 201 bp, Bos taurus; identical to SEQ ID NO: 33804

SEQ ID NO: 114826 - DNA, 201 bp, Bos taurus; identical to SEQ ID NO: 33805

SEQ ID NO: 114827 - DNA, 201 bp, Bos taurus
acaattagagataacctcctcaccttcctcaaatcagttgtgcaagatttaagtaagcttagttgctgccttatttgaacataagaatgttgaatttgggraagtgcagataggcctctatgcaaatgtttggtgcaaaggagaaggggccaatttcaagttagacaaatcaaggatgcccctcagcatataatcgatgat

SEQ ID NO: 114828 - DNA, 201 bp, Bos taurus; identical to SEQ ID NO: 33808

SEQ ID NO: 114829 - DNA, 201 bp, Bos taurus
taggactcctaaaaacaggtgtactcaataggaaatttttttaaaacctttaaattttttaaaaggcaaaagatgttcattacagtggtacccataatagyataaattagaagcaaagtaagtgtccaaaactgaggcaatggttaagtgaattgtggttcaacaaatcaataaaatcaacctagcctctaaaaagtgtag

SEQ ID NO: 114830 - DNA, 201 bp, Bos taurus; identical to SEQ ID NO: 33809

SEQ ID NO: 114831 - DNA, 201 bp, Bos taurus; identical to SEQ ID NO: 33810

SEQ ID NO: 114832 - DNA, 201 bp, Bos taurus
caatagcctggaaatggccacttcctctgtcatttactgtctgggacagcctcaccaggcagtctgaggatgagagcttcgccaagtactctccagatcaycagggccaagggggtgggggacccagacccttggaggttaaggggtttgatcaaggtcattgtgaattgtggtgctggagaagactcttaagagtccctt

SEQ ID NO: 114833 - DNA, 201 bp, Bos taurus
agtctgtatactagtccccttaaatctatatcttagtattagactacacatgcataggttgaaacaaagacaggctagtcaaaggataattcaggaaatcrctgaccttaacacagtctggaggtgttagagtttgaccatgtggagaggagagtcctcactgagcactcagggcttcctgtggaaactccagagatgtcc

SEQ ID NO: 114834 - DNA, 201 bp, Bos taurus; identical to SEQ ID NO: 33814

SEQ ID NO: 114835 - DNA, 201 bp, Bos taurus; identical to SEQ ID NO: 33815

SEQ ID NO: 114836 - DNA, 201 bp, Bos taurus; identical to SEQ ID NO: 33816

SEQ ID NO: 114837 - DNA, 201 bp, Bos taurus; identical to SEQ ID NO: 33817

SEQ ID NO: 114838 - DNA, 201 bp, Bos taurus; identical to SEQ ID NO: 33818

SEQ ID NO: 114839 - DNA, 201 bp, Bos taurus; identical to SEQ ID NO: 33819

SEQ ID NO: 114840 - DNA, 201 bp, Bos taurus; identical to SEQ ID NO: 33820

SEQ ID NO: 114841 - DNA, 201 bp, Bos taurus; identical to SEQ ID NO: 33821

SEQ ID NO: 114842 - DNA, 201 bp, Bos taurus; identical to SEQ ID NO: 33822

SEQ ID NO: 114843 - DNA, 201 bp, Bos taurus; identical to SEQ ID NO: 33824

SEQ ID NO: 114844 - DNA, 201 bp, Bos taurus
ctaggggtgggagaggcgagaggccctgtcacccagcctgtgcagagggtcactcagctcaagcctgcagctgtctgctcagcattagcaccaattgtacyaacagggaaatgtctccatgctggcccacgggccctcacccaggaagggagagagctgagcatgctggctggagggggaatggcagacatgtctcctgag

SEQ ID NO: 114845 - DNA, 201 bp, Bos taurus; identical to SEQ ID NO: 33830

SEQ ID NO: 114846 - DNA, 201 bp, Bos taurus; identical to SEQ ID NO: 33832

SEQ ID NO: 114847 - DNA, 201 bp, Bos taurus; identical to SEQ ID NO: 33833

SEQ ID NO: 114848 - DNA, 201 bp, Bos taurus; identical to SEQ ID NO: 33834

SEQ ID NO: 114849 - DNA, 201 bp, Bos taurus; identical to SEQ ID NO: 33836

SEQ ID NO: 114850 - DNA, 201 bp, Bos taurus; identical to SEQ ID NO: 33837

SEQ ID NO: 114851 - DNA, 201 bp, Bos taurus
tggacgattcagtactgagctgtcacagtctggtctggcttaagattcaaattgctccagtgatgaacttggcagggggcctatcagcttgttcctgatarccgaatggtatcactagagctgagcaggtcatagtattcacagcttagtagttcaggcctacagttcttatctgtacataaaacagaggaagaagattaa

SEQ ID NO: 114852 - DNA, 201 bp, Bos taurus
tctggctttccagactcttgaactgcccctgactagaaccctatcagggtcccctcagagttccaaagcctgacttatatatactttatctcctcaagggsaagatacagatggttgtttgcatcatcatgggtacacgtgatgatctctacggggccattaaaaagctgtgctgtgtgcagactcctgtaccctcacagg

SEQ ID NO: 114853 - DNA, 201 bp, Bos taurus
gaatgacaggccagttaaaaggaaattccttccaaaacatgacgttaaccatgtgcattttaaggagaggaaaacaactgattcaataaaggaggacattkttttttcttccttaaaataaaggattaggtctttaattatagattctcataaggaaggaaaaaattctctttgatctactgtatcctcccagaataggac

SEQ ID NO: 114854 - DNA, 201 bp, Bos taurus
tcccaaacaaagctgtggacccaggcagtaaacttggatgaaacaaacaggccactgaagaggatccttctaattgcctgggtgtctgtaatgggctcacygtgtagctggagatgctaatgtgggccagagcagccacccatctcagaatcctcagtcatggacccctgtacgctgtaatcaaaccaatacccgaaggac

SEQ ID NO: 114855 - DNA, 201 bp, Bos taurus
tgaccacttgccatcaccgggcactcaggaccactcacagcaagtgagcgactgggcagcagacctgtccagaggctgggggttggatcagatggcccatyaggtcccttataactctataattccacacagaggactcaccacaccaatgcctcttggctctgcagacccacactggtccacggagagtctagggggcct

SEQ ID NO: 114856 - DNA, 201 bp, Bos taurus; identical to SEQ ID NO: 33842

SEQ ID NO: 114857 - DNA, 201 bp, Bos taurus; identical to SEQ ID NO: 33846

SEQ ID NO: 114858 - DNA, 201 bp, Bos taurus
tctcagagcccctcaccacaccagtactgactcacctggtctctgtgatcatgccccacatcaaatgttatttgccctccttttggacttttcaagttcamccactttttgttgttgtttatatcagctcaagtcctcttcctgcaaaataccatctttgttcacccagcccaaatttagtatcctattttataccccctc

SEQ ID NO: 114859 - DNA, 201 bp, Bos taurus; identical to SEQ ID NO: 33848

SEQ ID NO: 114860 - DNA, 201 bp, Bos taurus
atgtttccccaaggccatggtttcttttattagagaatggtgttagaaaccaagatctgggtactagatgtacttaatcaatgcttctatagtgtcattgyttctaggccctcttagatgaaagaacaagaaaatatatgtgtgtgtcctaaattgtatatatacctaacattatatgtgtaatgtgtgtgcgttcaattg

SEQ ID NO: 114861 - DNA, 201 bp, Bos taurus
aattagatttagatggggtcatgggagtgggatttccaggatgggattagtgtctttagaagaagaaagaccagaagtctctatctctattcaaaggcacygaggaagggccatgtgaagacacagcaagaaagaaactgtctacaagcagaaaacaggtccttaccaagaactgaatctgttggcaccttgatcttggac

SEQ ID NO: 114862 - DNA, 201 bp, Bos taurus; identical to SEQ ID NO: 33849

SEQ ID NO: 114863 - DNA, 201 bp, Bos taurus; identical to SEQ ID NO: 33850

SEQ ID NO: 114864 - DNA, 201 bp, Bos taurus; identical to SEQ ID NO: 33852

SEQ ID NO: 114865 - DNA, 201 bp, Bos taurus; identical to SEQ ID NO: 33854

SEQ ID NO: 114866 - DNA, 201 bp, Bos taurus; identical to SEQ ID NO: 33855

SEQ ID NO: 114867 - DNA, 201 bp, Bos taurus; identical to SEQ ID NO: 33856

SEQ ID NO: 114868 - DNA, 201 bp, Bos taurus; identical to SEQ ID NO: 33861

SEQ ID NO: 114869 - DNA, 201 bp, Bos taurus; identical to SEQ ID NO: 33862

SEQ ID NO: 114870 - DNA, 201 bp, Bos taurus; identical to SEQ ID NO: 33863

SEQ ID NO: 114871 - DNA, 201 bp, Bos taurus
catgagggaggaaataaaaatctagttggattcacatggcttgttcacacattccagaattcacccccaagtggctctgaattttttagaacacataagcrctgactgtgactttgaatttcaggacccagtttgtggcttcacacacagatttttctcctttcacccaatattcctgggccactggcagtactcagtact

SEQ ID NO: 114872 - DNA, 201 bp, Bos taurus
acaatctcaacagtggtttcaaaaaccaggcctcttttttcataaccctccagcagcctcgtaatgccaggcaccttcctgttgtgattactggaccaaayggggccctaccacgtggagagttgctagtattttcacctcaagccctgagaatatttcctttttttttttttttttttgaaattctgatacatctctttt

SEQ ID NO: 114873 - DNA, 201 bp, Bos taurus
gggctagtcacaggccggggatgtgatgctaagggttatgggtcttagcccacagggactgtgagcaattccaacatgataagcagaagcgtaaatgatayggccagctttgcacttttgtaaaagtactctgactgcaggaccgaatagactcaggagcagggtcccagtgaattaggcctgtgagagatggtgacaact

SEQ ID NO: 114874 - DNA, 201 bp, Bos taurus
gggggaagaccattactacaacattttccaaagtgacttgctataaaatgctagtctggagagatgctctgtcaacacagtgtcctacagggtcgaagggytatggaatatgtggacagttacaacacacataaacacataagagcctgttttatttggttagtcatttgacactgtaccatttctacacttatttactca

SEQ ID NO: 114875 - DNA, 201 bp, Bos taurus
ccttcctcttcttggtgctctcctttctggggcagtggtctgtaaggcagtacaagggagtggggtccatattctaggggccagaggtggtgccttggaakagaagtgcataacagacaaggaataaaaaatttctgtagcttttctggaaaggtccaggttagtggtttcttgttacctttaaactggtgtagcttaggc

SEQ ID NO: 114876 - DNA, 201 bp, Bos taurus; identical to SEQ ID NO: 33873

SEQ ID NO: 114877 - DNA, 201 bp, Bos taurus; identical to SEQ ID NO: 33875

SEQ ID NO: 114878 - DNA, 201 bp, Bos taurus
cacccctcaactcatcgactcccggcccggccacttcgcgaacattcgacaccatgagactcactcggaggactcgatttcgatcgacatagcgttgtctytccgggcgcaggccccactccactctcaggcccagtcgcgcaacgcaccaacgccacctccggcgactcacgtacgtcacttccgctcgacaacgacgcc

SEQ ID NO: 114879 - DNA, 201 bp, Bos taurus
aagttaatccacactcaggagacgatgggtctaccgaagacagagatgtgacctgggaggtctgctcccttccctgctggaggcctcatcatcaattttckaagctaaagagggttactctgagctgcctggtagtccctaagcagagttagcagggcgaaggctgctccgaattagtaggactcaaactcccgaaacttt

SEQ ID NO: 114880 - DNA, 201 bp, Bos taurus; identical to SEQ ID NO: 33876

SEQ ID NO: 114881 - DNA, 201 bp, Bos taurus; identical to SEQ ID NO: 33880

SEQ ID NO: 114882 - DNA, 201 bp, Bos taurus
ttcttatattttacataaaggttctggagtcagtgtattcttaaagcaaagtaaaaagcctaagttaccaaaattactaccaatatccttaaaaattaccmccaatgaattatgaaaatgagtaaggcatggaaattagatgtaaaaatcaacaccttcagcatactctcacatggggaaattctgtttccttttctggaa

SEQ ID NO: 114883 - DNA, 201 bp, Bos taurus
ccagtagaccatttcgaatgaggcatgtgcctaagaacaaggactttctttcatggcctgggagtaaggcctgctggcaggaatgggagggcccacgtaartccacaaagcccttctgtgatacatagcttgctgcaaagtctggctggaaagtgggagcagggccaagattccacagaggccagaggtctaggccaggcc

SEQ ID NO: 114884 - DNA, 201 bp, Bos taurus
ttacctttcagatttcattttggatttttagagattcatcgtgtttcattcaataacattcactactttttccagttttcaaatctacctagctttgggcrataggagttcctttaagatcaactcctgtgaacttttgatgtaactccattggtatttgaaagcgtccttgatttttccatgtaacatctcctaagttta

SEQ ID NO: 114885 - DNA, 201 bp, Bos taurus
gctgcccacctacccccgcccccccccaccccagtgccatggtcaggccacacggctacttctgtcctctctcttcgctgtccacttccagttcggttgtyaaatcagtctgtcctcactgaggcctcctctgctatctgtcatgaattccattctttatttgtcagtaaagtaaaacagctatattacacctctatgaag

SEQ ID NO: 114886 - DNA, 201 bp, Bos taurus
acggttttgtgtctacattcatccattgagcactgaatctcctagatttgagatctttcatcaaaattggaacactaacatagaaggttccttttacaaargtccatgttctagctttggtttttccctaagtaaaaaacaaggtctgtctgcgtcttgagctgcttctctggtggaaatgggtttaagccagtttactat

SEQ ID NO: 114887 - DNA, 201 bp, Bos taurus
agccatgctcttactcagcactgggtcactgtacccggcttgtaagaagtgttgacttagcagaaacaaagacatcatattaaagaactatttttagaacmtttttagaactattaaaagatggtttctattatttgatttataaaaagttgaatatgtaagagaatcaaaaggtaagagattagagatacgaaagtagag

SEQ ID NO: 114888 - DNA, 201 bp, Bos taurus; identical to SEQ ID NO: 33881

SEQ ID NO: 114889 - DNA, 201 bp, Bos taurus
accacaagatgcacagacaactctcccataaggaaggggtaaaaggctgtaggtagatggctggaaagtgttttcattgggaaggcaaacatgaattcacrgtcctaagatagggatacggtagctctggtgaaacaaacccttactggccccagcagtcactttcaccaggcctgttttgtgcagcagggaggttgatgc

SEQ ID NO: 114890 - DNA, 201 bp, Bos taurus; identical to SEQ ID NO: 33884

SEQ ID NO: 114891 - DNA, 201 bp, Bos taurus
ccgctgcgagtgcagcctggaggccaggagtaggagacgatataatcaagtcgccgaggtttggggagcactcctaaaccagtgtcctggaagaatctccrggcgctgcgggtttcactctggcctgtgtaactaacaaagtgccctttgcagctgagaggattctcgttccttaaagggtctcatctgggaaaagttcaa

SEQ ID NO: 114892 - DNA, 201 bp, Bos taurus
cttttcaaagtgctcttccacgagagagacacttgtttgcagtgaatgttgtctgggcactagtactcaatggtggggagagcacttgttaatcagatgaytgggatccaatcccagctctgccgctgcccatctgtgtgagcttgggaaagtcatgacatctctctgggtcctgataacatcctcattatttaagcaagt

SEQ ID NO: 114893 - DNA, 201 bp, Bos taurus; identical to SEQ ID NO: 33888

SEQ ID NO: 114894 - DNA, 201 bp, Bos taurus; identical to SEQ ID NO: 33889

SEQ ID NO: 114895 - DNA, 201 bp, Bos taurus; identical to SEQ ID NO: 33890

SEQ ID NO: 114896 - DNA, 201 bp, Bos taurus; identical to SEQ ID NO: 33891

SEQ ID NO: 114897 - DNA, 201 bp, Bos taurus; identical to SEQ ID NO: 33893

SEQ ID NO: 114898 - DNA, 201 bp, Bos taurus; identical to SEQ ID NO: 33894

SEQ ID NO: 114899 - DNA, 201 bp, Bos taurus; identical to SEQ ID NO: 33895

SEQ ID NO: 114900 - DNA, 201 bp, Bos taurus
gggctgggcgtgttggcgggatctcccttcttgcaccagtctccctgagtacccctcacacactgtctgccggtcatcccgtgactctgacagactggtgrgacaagtataaatgactaatgatataaaaaaaagttgcttggcctcattattagcaaaaaaaaaaagggggggggaattaaaacaattaattagatagat

SEQ ID NO: 114901 - DNA, 201 bp, Bos taurus
gaactgtcatgcccagagtgaaaagctcctagagatgagttctgttcagaattacagaggtttacatcggagtctcagtttgcttaagagttcccagaatratgctgacctctttttaaaagaggtaacagaagaggaagcactatagctgttgcgtttttttttgctgctgcttttttgatgttgtaatttgtttggcta

SEQ ID NO: 114902 - DNA, 201 bp, Bos taurus
ttagagtctcaaaaaattatttgctaacgtaacaccccacagattacttcctggttgagtggattaagcttgtctcccttaatcctgaggtcaatcaaagmgtcactaatggtagggaactaagtgttacttgtctccttgtgtggggcaaaatgaagtacactacagctctctgatggatcctagccaggaagtgttcgt

SEQ ID NO: 114903 - DNA, 201 bp, Bos taurus; identical to SEQ ID NO: 33897

SEQ ID NO: 114904 - DNA, 201 bp, Bos taurus
atttttactgaaatgcatgactctgaccttgaaaactgcattctcattaatctctctttttcatgagtttaaaatgtttccatctgagcattaatcatatraacatgatgttgacactttcccaagaaatggtcaataccaacaatagctcaggaatgcatattttgacaaagctgaatttgatgatctgcatgttttgag

SEQ ID NO: 114905 - DNA, 201 bp, Bos taurus
ttcttgccaggaaaatcctatggacagaggggcctggtaatctacagtccatggggttgcaaagagttggacacaattgaaacttctgagcacagcacatytgggatcttggccccacaggatatccagcccaggtcctggcatatatttcaccatctgtgtgtggtccgtttccaatgcagagatagtagtggggtgtgg

SEQ ID NO: 114906 - DNA, 201 bp, Bos taurus
ctgcaaatgtgtttttccttttacagtaggttttgcagttaaaaaatcataaagatttactcatgaaggtttttacaaagtcgtaagatttactcatgagmtataaatgagattagaagatagaaataaataggccctcacattaagctatttagcgtggacttaatagaatggtggacgacattggttcgatactgttgc

SEQ ID NO: 114907 - DNA, 201 bp, Bos taurus; identical to SEQ ID NO: 33898

SEQ ID NO: 114908 - DNA, 201 bp, Bos taurus; identical to SEQ ID NO: 33899

SEQ ID NO: 114909 - DNA, 201 bp, Bos taurus; identical to SEQ ID NO: 33906

SEQ ID NO: 114910 - DNA, 201 bp, Bos taurus; identical to SEQ ID NO: 33907

SEQ ID NO: 114911 - DNA, 201 bp, Bos taurus; identical to SEQ ID NO: 33909

SEQ ID NO: 114912 - DNA, 201 bp, Bos taurus; identical to SEQ ID NO: 33910

SEQ ID NO: 114913 - DNA, 201 bp, Bos taurus
aatctcaatcactccacacatcctcacaaaaacaagtaaagaaaatcaacaagcagtgcaaataaaagcacacatgcccaggcctgcagcattactagacracagaatgtaagagacttgctcataggtagaaagatgggcagatataccagggaagtggaaacaaagtagactgcaggccaaaaaatactaagtaagaca

SEQ ID NO: 114914 - DNA, 201 bp, Bos taurus; identical to SEQ ID NO: 33911

SEQ ID NO: 114915 - DNA, 201 bp, Bos taurus; identical to SEQ ID NO: 33912

SEQ ID NO: 114916 - DNA, 201 bp, Bos taurus; identical to SEQ ID NO: 33913

SEQ ID NO: 114917 - DNA, 201 bp, Bos taurus; identical to SEQ ID NO: 33914

SEQ ID NO: 114918 - DNA, 201 bp, Bos taurus; identical to SEQ ID NO: 33915

SEQ ID NO: 114919 - DNA, 201 bp, Bos taurus; identical to SEQ ID NO: 73464

SEQ ID NO: 114920 - DNA, 201 bp, Bos taurus; identical to SEQ ID NO: 73466

SEQ ID NO: 114921 - DNA, 201 bp, Bos taurus; identical to SEQ ID NO: 33920

SEQ ID NO: 114922 - DNA, 201 bp, Bos taurus; identical to SEQ ID NO: 73474

SEQ ID NO: 114923 - DNA, 201 bp, Bos taurus; identical to SEQ ID NO: 33924

SEQ ID NO: 114924 - DNA, 201 bp, Bos taurus; identical to SEQ ID NO: 33925

SEQ ID NO: 114925 - DNA, 201 bp, Bos taurus; identical to SEQ ID NO: 73478

SEQ ID NO: 114926 - DNA, 201 bp, Bos taurus
atctcttgacaatttcttccacccaaactttttcatacccctcccttattttcatggtttttcctatagggttggccttactttctggacatctgagtggrtgcctcttctctctcttctaattacggaggtagctcttttctctctcaacgcagggcagggggcctcctgcttttctctgttcctgcctcatcttgctcc

SEQ ID NO: 114927 - DNA, 201 bp, Bos taurus; identical to SEQ ID NO: 33930

SEQ ID NO: 114928 - DNA, 201 bp, Bos taurus; identical to SEQ ID NO: 33933

SEQ ID NO: 114929 - DNA, 201 bp, Bos taurus
agtggaacagaatagagaactgagaattgaactgacatttacatgggcaataaatctataacaaaggagacaataatatacaagagtagaaagacaccctyttcaataaaagggattgggaaaactggacagctacatgcaaaagaatcatactggactattttctcccaccatgcacaaaattaaattcaatgtggatta

SEQ ID NO: 114930 - DNA, 201 bp, Bos taurus; identical to SEQ ID NO: 73484

SEQ ID NO: 114931 - DNA, 201 bp, Bos taurus
cccacctgtggcttttcttattgtggtacacagggccatccccagagtacagccctctggggacagctgggcagtgacaggccaaagaggtcaaaggaggractgacacttccatctggtcccctaacgtcacttcaccaccagtaccctcactatccatcaaaaaggcaaggcagggtccatgtccttctctgcaactcc

SEQ ID NO: 114932 - DNA, 201 bp, Bos taurus; identical to SEQ ID NO: 73487

SEQ ID NO: 114933 - DNA, 201 bp, Bos taurus; identical to SEQ ID NO: 33938

SEQ ID NO: 114934 - DNA, 201 bp, Bos taurus
ctttcagggtcaacttcagatttttaagagttctaaaactggtaggccttggctccggatctctaacagatgaaggaacccagtaatatctgtattccacrtggaatgaatagaaaattggctaaggtctctctgagtggatgagactagtgggaaggagggatctagaagcctcaggagggggcagggatctgtgcttct

SEQ ID NO: 114935 - DNA, 201 bp, Bos taurus
aaacactatgaatgttaagtccatcatccctgtgggttcattcagtcccaaggccctccttctatctactttaattaaacctacttcctatttcatctccrctgaaactagcctccagtccacttccccagtctgctcccttctccttccatgaagcctcggtttctagaacgtggtccagtccttctccctaaacccaca

SEQ ID NO: 114936 - DNA, 201 bp, Bos taurus; identical to SEQ ID NO: 33940

SEQ ID NO: 114937 - DNA, 201 bp, Bos taurus
agctatttgaggaaatgattccagtagcatcagctttaaaatgaacacccatgtgaaacgggattatagaaaagaacacaaggggagggctaaaaagtcartagagaaattgttggaacagccacagaagctgaaatcacagaagtggatgatgtaagtgggagtaagagaaaacctatctttaaagacactagcccgtgt

SEQ ID NO: 114938 - DNA, 201 bp, Bos taurus
ataaatcagtataacccctttggaaaagtctttaaaagtgagagacaatgaagcatggtccttgagtcaaatctggccattaccagttttttgtacagccmaagagctaagaatggttttgacaggactgacagaccatgtggcttacgaagtctaaaataagtactatctggccctttacatagtttgccaactctagta

SEQ ID NO: 114939 - DNA, 201 bp, Bos taurus; identical to SEQ ID NO: 33943

SEQ ID NO: 114940 - DNA, 201 bp, Bos taurus
tccacagggcctcctctagctgatgtttctaccaccttgatcaggccagaggcaccatgtgaaacaccgagtgtgtcagtggacacttttcaaaggcccartgcattccaggagtacaaatcctcatccttttctcccactgtgtgatttatttgctcagaaaagaagacctttttaactttgcacaggattggcgagctt

SEQ ID NO: 114941 - DNA, 201 bp, Bos taurus; identical to SEQ ID NO: 33949

SEQ ID NO: 114942 - DNA, 201 bp, Bos taurus
ctgtgtggtatgtttctattccattctattctttattcttacgatttcctttaggtgaaataggctggctgtgatccattaatcacaccctttaatagctygtgtcccatagtttggcctgtatttttaaagcatgacttgtagctcgagtacttttcagcagaggacgataggttgtctgagtaagagcccatctcctgt

SEQ ID NO: 114943 - DNA, 201 bp, Bos taurus
ctgtggtaaatgaaaaggctgggccagaacagggctcccgtgccagctcacctaacccagtgccagccatgggtaccttgctgggtctttggagggaaatrggtgccagcagtgccacctgctggccgcactaggcacggcactacaggtgatgggtggagctgaagtgtcccaaggaccaaattccaacctctctaggtt

SEQ ID NO: 114944 - DNA, 201 bp, Bos taurus; identical to SEQ ID NO: 33960

SEQ ID NO: 114945 - DNA, 201 bp, Bos taurus
cggacacgattgaagcaacttagcagcagcagtagcagcagtccccaccagaaagagccctgtgtctactgctgatctgaatgggagcagaggagagaaakaaccaaaatatgaatgggaagctccctctggggcactaggtgaataagccataacgcacagccctacctcaatgcttgcctggaaatctcagacccaaaa

SEQ ID NO: 114946 - DNA, 201 bp, Bos taurus; identical to SEQ ID NO: 73508

SEQ ID NO: 114947 - DNA, 201 bp, Bos taurus
ctgaagtcccacctgtgtagtgggtgggtctcctctggcctccttgttcatgctctgagccctgacttctcttctgtacccctgtggccctagaaccttgraacaagagcctgaactacaggggtgcctgtgttctactcacttctgtgattttgattcccgttgttcatctctgaaatggcctggaaggtcattgctgtt

SEQ ID NO: 114948 - DNA, 201 bp, Bos taurus; identical to SEQ ID NO: 33962

SEQ ID NO: 114949 - DNA, 201 bp, Bos taurus; identical to SEQ ID NO: 33963

SEQ ID NO: 114950 - DNA, 201 bp, Bos taurus; identical to SEQ ID NO: 33965

SEQ ID NO: 114951 - DNA, 201 bp, Bos taurus
gagaagagaaacatgattatggatttagacctcagggccagtgtcagatggggctatctgtgttttatactaatgcaactggggaatcctcagggtgactratgaggatgtcctggccaacatccccagttgtgtaaggtaagcccagggatctcacctgcatccgactttccccccaaacaacaagggtgcaaaccagta

SEQ ID NO: 114952 - DNA, 201 bp, Bos taurus; identical to SEQ ID NO: 33967

SEQ ID NO: 114953 - DNA, 201 bp, Bos taurus; identical to SEQ ID NO: 73514

SEQ ID NO: 114954 - DNA, 201 bp, Bos taurus
tgaacaagtgctgagaaattggaggcatcaatttgactttaaatatctattctattttcctcaagtatctgctccatatttctagcagatatcaaggcttkgcaattgccttgaggattttggcctgaaagagaggcagcctttggcagcctatcttgtacataagcctcagctgcagaggagataatgcacgcaagacat

SEQ ID NO: 114955 - DNA, 201 bp, Bos taurus; identical to SEQ ID NO: 33988

SEQ ID NO: 114956 - DNA, 201 bp, Bos taurus; identical to SEQ ID NO: 33989

SEQ ID NO: 114957 - DNA, 201 bp, Bos taurus; identical to SEQ ID NO: 33990

SEQ ID NO: 114958 - DNA, 201 bp, Bos taurus; identical to SEQ ID NO: 33992

SEQ ID NO: 114959 - DNA, 201 bp, Bos taurus
ttattttctcttgaatgaaggacaccagactcctcacttcttttagttttgtcacttgatactaggcttgcagtaaacgtggcctgaatccacatgccttygcacttaattttactggactggtccttccccggggaccacaggaactaccaccaggaacttcctctctgacttagttttctccttgtcccagcatcctat

SEQ ID NO: 114960 - DNA, 201 bp, Bos taurus; identical to SEQ ID NO: 73543

SEQ ID NO: 114961 - DNA, 201 bp, Bos taurus; identical to SEQ ID NO: 73544

SEQ ID NO: 114962 - DNA, 201 bp, Bos taurus; identical to SEQ ID NO: 73545

SEQ ID NO: 114963 - DNA, 201 bp, Bos taurus; identical to SEQ ID NO: 33993

SEQ ID NO: 114964 - DNA, 201 bp, Bos taurus; identical to SEQ ID NO: 33995

SEQ ID NO: 114965 - DNA, 201 bp, Bos taurus
tattcctgtttgaagccttaatgaaatttgtgtccaggatgagtcagtccacctgctgttcactagctgagtactctattaaggtcagctggcttccttgytacagttatttaaattttggatgttctactcatcagtgtctttaaatttcttgaggccagaataatttcaaatactatagccccctttcatcttataatg

SEQ ID NO: 114966 - DNA, 201 bp, Bos taurus
ggttcaggccttgaagtggtggtgaacctctgccccatcccctgcaacctaatggcggcagcagtcatcctggctcacagtgcttgagacccatcctcgtytggggagtctgaggggcctaaggtctggctgggtcctgggcacctggcttcctcagtgatgacagctgggcagagtctggggacctggccctgggagcac

SEQ ID NO: 114967 - DNA, 201 bp, Bos taurus; identical to SEQ ID NO: 33998

SEQ ID NO: 114968 - DNA, 201 bp, Bos taurus
caggtcttttatgtctcctgtattggcaggctagttcttggccactagcaccagcatgacactttccaaaacttaagtgaatatttctgtatactaggctrctatttaggaacatgccatagtggccacagaacctactgctcctcatctgatggtgaccccagagatattcttatattctgagtctgtttttccagaagg

SEQ ID NO: 114969 - DNA, 201 bp, Bos taurus; identical to SEQ ID NO: 33999

SEQ ID NO: 114970 - DNA, 201 bp, Bos taurus; identical to SEQ ID NO: 34000

SEQ ID NO: 114971 - DNA, 201 bp, Bos taurus; identical to SEQ ID NO: 34001

SEQ ID NO: 114972 - DNA, 201 bp, Bos taurus; identical to SEQ ID NO: 34002

SEQ ID NO: 114973 - DNA, 201 bp, Bos taurus; identical to SEQ ID NO: 73549

SEQ ID NO: 114974 - DNA, 201 bp, Bos taurus; identical to SEQ ID NO: 73550

SEQ ID NO: 114975 - DNA, 201 bp, Bos taurus; identical to SEQ ID NO: 73551

SEQ ID NO: 114976 - DNA, 201 bp, Bos taurus; identical to SEQ ID NO: 34004

SEQ ID NO: 114977 - DNA, 201 bp, Bos taurus
gcaagggaaaagaacttgaatattgcagcaaaactaggccatctattcacttcaacaggaatcgatcgcttataatttatctgcagagctccctgagaaargagagggaaagccacagtatcattatcatcatcgtacaattacttatgtgttaaatgggtaataaagcatgatgatatgcattgtaaagtagaatggtag

SEQ ID NO: 114978 - DNA, 201 bp, Bos taurus
aaatggacaagatggattagtgctataagtgctgatatgaggaaaattccatttgtgagctctcagaagacagccaactgacatgacagcactttctgctrgtaacatctgttgctgaggtagacctgtttattctctgctctttctttccttctgctttgtttcggtgggcaaggacactgcaagggtgtttgccacccc

SEQ ID NO: 114979 - DNA, 201 bp, Bos taurus
ggcatggaaatccaatccagtattcttgcctggagaataccatggacagaggagcctgccaggctataaagagttggacaggactgaagtgactgagcatrcacacactcaatcagtatatattttgaattatttatgtgtactgattaattgttgcttttgttgttcagttgcccagttgtgtctgtctctttgtgaccc

SEQ ID NO: 114980 - DNA, 201 bp, Bos taurus
ttttttatctggcaaacagttccaggaaaaaggcttatgacctctaagcttttaccttttgtctttatcgagagtgtaggttatatgaaatacttgtactrgcctattagcttaatgatgagtgataaataaaagggagaaatgaagtgataactaaggaaaaaatccaagtctttaaattttgtgtgtgcatgtgtgtga

SEQ ID NO: 114981 - DNA, 201 bp, Bos taurus; identical to SEQ ID NO: 73554

SEQ ID NO: 114982 - DNA, 201 bp, Bos taurus
gatgtccctctccactgggaatgagacaatgtcttccttactctgttcaggaaatgaagtacgcccacagttctgtgcacccaggtgtcaacaactccatmacactcggcctaaagcatcgctttgctggtgtctgtgttcagggaatttgccagaatgcttatcaggtgggtatgctccctgacaccacagaagaaaatg

SEQ ID NO: 114983 - DNA, 201 bp, Bos taurus; identical to SEQ ID NO: 73558

SEQ ID NO: 114984 - DNA, 201 bp, Bos taurus; identical to SEQ ID NO: 34010

SEQ ID NO: 114985 - DNA, 201 bp, Bos taurus
tcacagcgtgtcttagatgactgtgagtacacaccaaggaaatgccatagacacccagctcccaagtgaggaggacaacccctagtgttctatgtgtgtgkagagaaaccagtatcccatggagtaaaacaaggcagccaaggcaggcagagagcatcgcccgtgaaactgacaagttcccactgtctggacatatgcaca

SEQ ID NO: 114986 - DNA, 201 bp, Bos taurus; identical to SEQ ID NO: 34011

SEQ ID NO: 114987 - DNA, 201 bp, Bos taurus; identical to SEQ ID NO: 34012

SEQ ID NO: 114988 - DNA, 201 bp, Bos taurus
attgcgggcagacactttaccgtctgagccacaagagaagtccttagtaaatgttatggaaaaccccaaacaaactttctggccaagtcaatattttgctrtctccttcctccccaaccccttcctgtagaaaggagaattatttcagtttcataactttgactcagatttttgggactctcaggactattagagataaac

SEQ ID NO: 114989 - DNA, 201 bp, Bos taurus; identical to SEQ ID NO: 34013

SEQ ID NO: 114990 - DNA, 201 bp, Bos taurus; identical to SEQ ID NO: 73561

SEQ ID NO: 114991 - DNA, 201 bp, Bos taurus; identical to SEQ ID NO: 73566

SEQ ID NO: 114992 - DNA, 201 bp, Bos taurus; identical to SEQ ID NO: 73569

SEQ ID NO: 114993 - DNA, 201 bp, Bos taurus
gttctctgcatatgtgtgtgtgatttggcacttattattttcatttattttaaagcatcatgatcttaaatttgagaatatttgtcagcgattaaaaactkgaagttttaaacactaattcgaaagtggtaaagactgcaaaattagccaaagctagaaataaactgaaatcactcaccaagaaagccgtgaccttacctt

SEQ ID NO: 114994 - DNA, 201 bp, Bos taurus; identical to SEQ ID NO: 34021

SEQ ID NO: 114995 - DNA, 201 bp, Bos taurus; identical to SEQ ID NO: 34022

SEQ ID NO: 114996 - DNA, 201 bp, Bos taurus; identical to SEQ ID NO: 34023

SEQ ID NO: 114997 - DNA, 201 bp, Bos taurus; identical to SEQ ID NO: 34024

SEQ ID NO: 114998 - DNA, 201 bp, Bos taurus
ctctgggcaggcaggggagtggtggtgtatagatgcagctttgtttatctgcagggtgtggatcattgactaccagaactctgccatcgttttcttgtgtrtgaacaaagtgtgataatactttgcccggaaccgggtcagcatttggcagggagggagctctgtttcacaggcagagcaatctgttaacgtgtaatttga

SEQ ID NO: 114999 - DNA, 201 bp, Bos taurus; identical to SEQ ID NO: 34025

SEQ ID NO: 115000 - DNA, 201 bp, Bos taurus
tctctgtctgagcttccctcacctcacttcagctaagtttagcttgaatagagagttcagctttgccaaaccaccacactcctctctgtcggcctggacckctgaccgagacagggtgggctctgtctccttcccacttagcttgcttcatccttacaggatgttacttaaggccttatgaagcagccaatccttttcaat

SEQ ID NO: 115001 - DNA, 201 bp, Bos taurus; identical to SEQ ID NO: 34026

SEQ ID NO: 115002 - DNA, 201 bp, Bos taurus
tcaagtaagaagggaaaaaaagcagtaaatctggtggctctcaaagctgagacatttcttcttcaccctccacacaactctgctgaaaactgttctggtcmagtaactttgatccttttagaaaatctgttgtccgtgtggacaaaagcaattcttcatttgaataggacatcaattctttctcctgctttttccctgtgg

SEQ ID NO: 115003 - DNA, 201 bp, Bos taurus; identical to SEQ ID NO: 34029

SEQ ID NO: 115004 - DNA, 201 bp, Bos taurus; identical to SEQ ID NO: 34030

SEQ ID NO: 115005 - DNA, 201 bp, Bos taurus; identical to SEQ ID NO: 73577

SEQ ID NO: 115006 - DNA, 201 bp, Bos taurus; identical to SEQ ID NO: 73578

SEQ ID NO: 115007 - DNA, 201 bp, Bos taurus; identical to SEQ ID NO: 34031

SEQ ID NO: 115008 - DNA, 201 bp, Bos taurus; identical to SEQ ID NO: 34032

SEQ ID NO: 115009 - DNA, 201 bp, Bos taurus
gagggatgaggcagcagagcggggctagagaggtattcatcagtgccttgaaagtcaggacaaggcgttgttcctaaagacacgaaaggggtatggccacrttcaactgggaagaaacataatcagggtggtgctgtagataagttagttgctgctgcccagaagactgatgagaggaggccaagggaaagaaggaagaga

SEQ ID NO: 115010 - DNA, 201 bp, Bos taurus
agtgcctcatacccacagatactggaaacaaccaggctatcacatttcctccacattcatccagctctgactacctttctaatttgtgagatatggtgttratgtgaacaaatccactactgacaaataacgaccgtgcaaaaaagttgatttccaaaatcacttcctgtggtatccaggatggcctccaagaattaaagt

SEQ ID NO: 115011 - DNA, 201 bp, Bos taurus; identical to SEQ ID NO: 73582

SEQ ID NO: 115012 - DNA, 201 bp, Bos taurus
tattcacacagagcctatgatttggagataactccaaatttctcatttctaggatccaaagtaccccctgcagagggcacagcctggctgcagagggcaayaggaagaaacaggaaggccatctactctcctccatgagcaaagtcagaattcctgagagtacgaagaggcttctgagagaaggtgaggtgtacgtgtggt

SEQ ID NO: 115013 - DNA, 201 bp, Bos taurus
ccgcagaagaattcttataatgagattactttctacctactctagagatgtgcctacactgcatcctcatgcttggaaacgtctccctagcacgtccccaygtgcagcaagatactggacacctccagggtggggcgtcatggatgcatcacctcacatgggcgccagcacctccatcccagtgttctttaccgcaacagt

SEQ ID NO: 115014 - DNA, 201 bp, Bos taurus
ggagtcagagttcagggatgggccatggcccccagccacaccgccccggctttctcccggaggccctgagcccctcagggtccctcgatgagtctggccgmctggtgatgacttgggcagcccaccgagaccccaggggtctcttacctcaaactggatcagcaccgtcccactttcgaggcccttctttagctgctccat

SEQ ID NO: 115015 - DNA, 201 bp, Bos taurus; identical to SEQ ID NO: 73584

SEQ ID NO: 115016 - DNA, 201 bp, Bos taurus
tcatctgtaaaacagagtagtaatcctctctctagattcaggcaagaagaaagaatgttttaagttcttatgtgctgatgttattttatattttactgacrtttatttctgggaactaaccaattttaatccatgactcacgtttaccttacagtccactgagattcccaggtggttctggctacacctgggtctgctgag

SEQ ID NO: 115017 - DNA, 201 bp, Bos taurus; identical to SEQ ID NO: 34041

SEQ ID NO: 115018 - DNA, 201 bp, Bos taurus
tgtttctttttccttgtgttgttctatcagatcccttggagctgcagaacctcaggaattactatttaatgatatattgaggggctgccctaccctctccyttgggccccaccccctgccacctcttctcaggagcagaaaccatggagccccagccccataagagctgtagtccatgagcctgtagccagtgaccactgg

SEQ ID NO: 115019 - DNA, 201 bp, Bos taurus; identical to SEQ ID NO: 34044

SEQ ID NO: 115020 - DNA, 201 bp, Bos taurus; identical to SEQ ID NO: 34045

SEQ ID NO: 115021 - DNA, 201 bp, Bos taurus; identical to SEQ ID NO: 34046

SEQ ID NO: 115022 - DNA, 201 bp, Bos taurus; identical to SEQ ID NO: 34047

SEQ ID NO: 115023 - DNA, 201 bp, Bos taurus; identical to SEQ ID NO: 34048

SEQ ID NO: 115024 - DNA, 201 bp, Bos taurus; identical to SEQ ID NO: 34049

SEQ ID NO: 115025 - DNA, 201 bp, Bos taurus; identical to SEQ ID NO: 34050

SEQ ID NO: 115026 - DNA, 201 bp, Bos taurus; identical to SEQ ID NO: 34051

SEQ ID NO: 115027 - DNA, 201 bp, Bos taurus; identical to SEQ ID NO: 34052

SEQ ID NO: 115028 - DNA, 201 bp, Bos taurus; identical to SEQ ID NO: 34053

SEQ ID NO: 115029 - DNA, 201 bp, Bos taurus; identical to SEQ ID NO: 34054

SEQ ID NO: 115030 - DNA, 201 bp, Bos taurus; identical to SEQ ID NO: 34055

SEQ ID NO: 115031 - DNA, 201 bp, Bos taurus; identical to SEQ ID NO: 34056

SEQ ID NO: 115032 - DNA, 201 bp, Bos taurus; identical to SEQ ID NO: 34057

SEQ ID NO: 115033 - DNA, 201 bp, Bos taurus; identical to SEQ ID NO: 34058

SEQ ID NO: 115034 - DNA, 201 bp, Bos taurus; identical to SEQ ID NO: 34059

SEQ ID NO: 115035 - DNA, 201 bp, Bos taurus; identical to SEQ ID NO: 34060

SEQ ID NO: 115036 - DNA, 201 bp, Bos taurus; identical to SEQ ID NO: 34061

SEQ ID NO: 115037 - DNA, 201 bp, Bos taurus; identical to SEQ ID NO: 34062

SEQ ID NO: 115038 - DNA, 201 bp, Bos taurus; identical to SEQ ID NO: 34063

SEQ ID NO: 115039 - DNA, 201 bp, Bos taurus; identical to SEQ ID NO: 34064

SEQ ID NO: 115040 - DNA, 201 bp, Bos taurus; identical to SEQ ID NO: 34065

SEQ ID NO: 115041 - DNA, 201 bp, Bos taurus; identical to SEQ ID NO: 34066

SEQ ID NO: 115042 - DNA, 201 bp, Bos taurus; identical to SEQ ID NO: 34067

SEQ ID NO: 115043 - DNA, 201 bp, Bos taurus; identical to SEQ ID NO: 34068

SEQ ID NO: 115044 - DNA, 201 bp, Bos taurus; identical to SEQ ID NO: 34069

SEQ ID NO: 115045 - DNA, 201 bp, Bos taurus; identical to SEQ ID NO: 34070

SEQ ID NO: 115046 - DNA, 201 bp, Bos taurus; identical to SEQ ID NO: 34071

SEQ ID NO: 115047 - DNA, 201 bp, Bos taurus; identical to SEQ ID NO: 34072

SEQ ID NO: 115048 - DNA, 201 bp, Bos taurus; identical to SEQ ID NO: 34073

SEQ ID NO: 115049 - DNA, 201 bp, Bos taurus; identical to SEQ ID NO: 34074

SEQ ID NO: 115050 - DNA, 201 bp, Bos taurus; identical to SEQ ID NO: 34075

SEQ ID NO: 115051 - DNA, 201 bp, Bos taurus; identical to SEQ ID NO: 34076

SEQ ID NO: 115052 - DNA, 201 bp, Bos taurus; identical to SEQ ID NO: 34077

SEQ ID NO: 115053 - DNA, 201 bp, Bos taurus; identical to SEQ ID NO: 34078

SEQ ID NO: 115054 - DNA, 201 bp, Bos taurus; identical to SEQ ID NO: 34079

SEQ ID NO: 115055 - DNA, 201 bp, Bos taurus; identical to SEQ ID NO: 34080

SEQ ID NO: 115056 - DNA, 201 bp, Bos taurus; identical to SEQ ID NO: 34081

SEQ ID NO: 115057 - DNA, 201 bp, Bos taurus; identical to SEQ ID NO: 34082

SEQ ID NO: 115058 - DNA, 201 bp, Bos taurus; identical to SEQ ID NO: 34083

SEQ ID NO: 115059 - DNA, 201 bp, Bos taurus; identical to SEQ ID NO: 34084

SEQ ID NO: 115060 - DNA, 201 bp, Bos taurus; identical to SEQ ID NO: 34085

SEQ ID NO: 115061 - DNA, 201 bp, Bos taurus; identical to SEQ ID NO: 34086

SEQ ID NO: 115062 - DNA, 201 bp, Bos taurus; identical to SEQ ID NO: 73666

SEQ ID NO: 115063 - DNA, 201 bp, Bos taurus; identical to SEQ ID NO: 34096

SEQ ID NO: 115064 - DNA, 201 bp, Bos taurus; identical to SEQ ID NO: 34097

SEQ ID NO: 115065 - DNA, 201 bp, Bos taurus; identical to SEQ ID NO: 34100

SEQ ID NO: 115066 - DNA, 201 bp, Bos taurus; identical to SEQ ID NO: 73669

SEQ ID NO: 115067 - DNA, 201 bp, Bos taurus; identical to SEQ ID NO: 73670

SEQ ID NO: 115068 - DNA, 201 bp, Bos taurus; identical to SEQ ID NO: 73671

SEQ ID NO: 115069 - DNA, 201 bp, Bos taurus; identical to SEQ ID NO: 34101

SEQ ID NO: 115070 - DNA, 201 bp, Bos taurus; identical to SEQ ID NO: 34102

SEQ ID NO: 115071 - DNA, 201 bp, Bos taurus; identical to SEQ ID NO: 34103

SEQ ID NO: 115072 - DNA, 201 bp, Bos taurus; identical to SEQ ID NO: 34104

SEQ ID NO: 115073 - DNA, 201 bp, Bos taurus; identical to SEQ ID NO: 73673

SEQ ID NO: 115074 - DNA, 201 bp, Bos taurus; identical to SEQ ID NO: 73674

SEQ ID NO: 115075 - DNA, 201 bp, Bos taurus; identical to SEQ ID NO: 34106

SEQ ID NO: 115076 - DNA, 201 bp, Bos taurus; identical to SEQ ID NO: 34109

SEQ ID NO: 115077 - DNA, 201 bp, Bos taurus; identical to SEQ ID NO: 34110

SEQ ID NO: 115078 - DNA, 201 bp, Bos taurus; identical to SEQ ID NO: 73679

SEQ ID NO: 115079 - DNA, 201 bp, Bos taurus; identical to SEQ ID NO: 73680

SEQ ID NO: 115080 - DNA, 201 bp, Bos taurus; identical to SEQ ID NO: 73688

SEQ ID NO: 115081 - DNA, 201 bp, Bos taurus; identical to SEQ ID NO: 73689

SEQ ID NO: 115082 - DNA, 201 bp, Bos taurus; identical to SEQ ID NO: 73690

SEQ ID NO: 115083 - DNA, 201 bp, Bos taurus; identical to SEQ ID NO: 73691

SEQ ID NO: 115084 - DNA, 201 bp, Bos taurus; identical to SEQ ID NO: 73692

SEQ ID NO: 115085 - DNA, 201 bp, Bos taurus; identical to SEQ ID NO: 73693

SEQ ID NO: 115086 - DNA, 201 bp, Bos taurus; identical to SEQ ID NO: 73694

SEQ ID NO: 115087 - DNA, 201 bp, Bos taurus
agaatcatgctgtccccagtaaaagagaaaatgtacgttaagaagcttctgcccctaaggtttagagtctgttgaagacagaggctgaaccaagagagtcwtgtacctccttgacccactataagctcaagctgaataataagccaacagcaatctgctgggatccagtgggaatagagtgagcatgtcacctctggtgca

SEQ ID NO: 115088 - DNA, 201 bp, Bos taurus
gtgtgaatttgtgagaatttgcaaacccattcatgccttgttttcctggtatacctaatgagataacactaacttacaatatcattggtagaattataccyactactatacactcctttggtttcagtgattctagtgatgatttttagattctgattctagcagggatagaaaatcaatattctctcatatgctaagcaa

SEQ ID NO: 115089 - DNA, 201 bp, Bos taurus
gtgctcatccagaaagtacaactcaggtgcagattttgaaagagtcacctgggagtttttagatgtttacactgcagccctggaagtacgtgcctgagagraagcatagctggtgttgaactgtctcacaagtgacactgagctctgatttgaatgaggccactgtaggcatgtcaagcttgcatccatgaacccaccaca

SEQ ID NO: 115090 - DNA, 201 bp, Bos taurus
tgtcagccctgaaatgataggatcaacctctcttccttggatgaagaacttgatgctgatctactttcacttaatgaataacagatggccatgatattgtmcatttgataaacttatgggttgtaggtgtgtgagagtctctgtattaaaaactaataactgtatggaaagaactgtctagacatttttctgctatcatca

SEQ ID NO: 115091 - DNA, 201 bp, Bos taurus; identical to SEQ ID NO: 34126

SEQ ID NO: 115092 - DNA, 201 bp, Bos taurus
caccgccaggacggaagagagccctggctcctggtggcacctctgctgaggaggagcgcagctcctgggaacgtgaactctacgaccagaagcacacatcyaggccctgttcaaagagtccatcatgtagctgtgcactgcacggcccgagaggccatgacattcctcagggaatactttgagaggttggagaagaaggag

SEQ ID NO: 115093 - DNA, 201 bp, Bos taurus
ccctcatggagatggccgagtggagcagacgcaaaggcagtgaggaaatgtattcctgtggtcatctggagcagagcgtttcagccaggggggccctgggrtaaaaggtattaagtatgaatgcagcaggcttgcccaagcagagcaaggagccccgggcggcaggagtgcacctcggggagaccaaccggaggcggggtt

SEQ ID NO: 115094 - DNA, 201 bp, Bos taurus; identical to SEQ ID NO: 73700

SEQ ID NO: 115095 - DNA, 201 bp, Bos taurus
cagtaaacactccccagcatcaaagtgcagtcaggacccagagcgtgtgttggagggaaggaggggagccaggtttacatgatccctgtgtcgtggtacakatgtaggggagaagtgaactcgagagaaaccaagctcgctgcagtatgtggcaggaacttgagtcaagagagagcagagacgggtaaggaaagggtggcc

SEQ ID NO: 115096 - DNA, 201 bp, Bos taurus
agctcgtctcacccatgtttgactagtcccctgtattgaattacttctatttgcaacacctagaaagttttctgttttcctgactgtactatcattgatakagctcattgaaaagctttttaaaaagtatagattgcagtgatctttcctgtgcacagttggtcattctgtgcatgcatctgaactaaagagaacaggccc

SEQ ID NO: 115097 - DNA, 201 bp, Bos taurus; identical to SEQ ID NO: 73702

SEQ ID NO: 115098 - DNA, 201 bp, Bos taurus; identical to SEQ ID NO: 73703

SEQ ID NO: 115099 - DNA, 201 bp, Bos taurus
tccatagggttgcaaagagtcagacatgactgagcgtctgagcacctctcttttttttttccttcccatttctaaatagcagacttataaatagtatatcrttttttagatactatcaattggcatcctacacagaagcacattttttaaatctcttaaaccacatgttttaaaaatgtgttttaaatctcttaaaccaca

SEQ ID NO: 115100 - DNA, 201 bp, Bos taurus
gggcagaataggccctcagggagttaggcattttcagaagacaactgtatgagcctgattcttgcatctcttcagatctagcactaaaatcattaatgccracttctgctcctcatgactggccaataaccttctgccaacatgtgtgcctgactgcatgcaccccttcactaaaatcatatacaatactgactttccctc

SEQ ID NO: 115101 - DNA, 201 bp, Bos taurus; identical to SEQ ID NO: 73704

SEQ ID NO: 115102 - DNA, 201 bp, Bos taurus; identical to SEQ ID NO: 73705

SEQ ID NO: 115103 - DNA, 201 bp, Bos taurus; identical to SEQ ID NO: 73706

SEQ ID NO: 115104 - DNA, 201 bp, Bos taurus
ggaaactcaactgtggttcccattagatctgggggctccaggaacagcaagaaacttttgaagtaaaatcattttgggaaaatttggcccctgaaataacrtaacctaagtaggtccccaaactatatgtgaggatttacgttgactagatgggaaaggtatctcctgactgccacagtgggtggcctttggagaataagg

SEQ ID NO: 115105 - DNA, 201 bp, Bos taurus; identical to SEQ ID NO: 73707

SEQ ID NO: 115106 - DNA, 201 bp, Bos taurus
ctcctctagccatgctttgtatcagcacggaaaacagaaaaatagcacatctctaggggatgtggctatagggcaaccactgattccaagaccccggggtytgtattgtttttctgacactaatcagagaactgcctttggcgtttacatgcaccctgtttctctgtggtcactatccccgacctgatggaggttgatcag

SEQ ID NO: 115107 - DNA, 201 bp, Bos taurus
gtgctcaggccatgctcctgctgtggatcctgggccgtgctatgagtagcaagaactggaggatttcacagttcctgaaggttttcctctagctttctgtmctgttaccaaggcccaccccctgaaaccatctttctccccatctaccttaccctcccagctcttctccttgtcagttccctcttaatctgtgaattatca

SEQ ID NO: 115108 - DNA, 201 bp, Bos taurus; identical to SEQ ID NO: 73708

SEQ ID NO: 115109 - DNA, 201 bp, Bos taurus
aagacaaaaaccttctaagcaaaagggttatctgcatagctgaccttacgtgcacttttataatgtgaccttgttcaggatgggaaggtgggataggactyaggatggaaatgccatcaaaatatgtgatttcctcctgcctacgttcatcaacaaggcagttttactgagcttctgaaaataagcaaacattctttttgt

SEQ ID NO: 115110 - DNA, 201 bp, Bos taurus; identical to SEQ ID NO: 73709

SEQ ID NO: 115111 - DNA, 201 bp, Bos taurus
aaatcgtattttgtacttaggtctccctgaggcttatgttactgtgttgtataagcatctgttactaatagggttagctggagccagctcactttcttttytgggaagcagaaggtaaaacctaaacatttactgaatcaactgattaatagggcagatgtttttgacatttaaatagatgtctgtctgttgtgctttaga

SEQ ID NO: 115112 - DNA, 201 bp, Bos taurus
gtgggactgtggaagaggctggctgtgaaagtgcagtgtgaaacctggcataatgctaaagttcgcaatttacacgttattttcctcaattcaggccttamttctcttcctagtcagaggcagatgagtttttcatgccatgcaaagtgacgtcaggcaaaacctcctgtgttctagggcctgtttagagtgagtggcagc

SEQ ID NO: 115113 - DNA, 201 bp, Bos taurus
tcaggcccagagaactgttacaaatacgggtctccagcgccatctagtggacaggaagtggggggtgatggcgcacagacaccgggttctaaaatgtgaawgcagggttctgggtgtggcccggtcttcctattccttttggagtgtcttggccattctccgagcaggatgaaacctgagaaggatggcaggagcccctgc

SEQ ID NO: 115114 - DNA, 201 bp, Bos taurus
ttaatggagagtgttgaatgtatttgttttggaatatgatatgaaattttgaattgtagagtctcctattctcatattttaggattctttttctttttttyccctaatttctatcggaacacttgttctgattcatgtgttgagttcaattcacagacaaatcatcctgtgtaatgtcatctttttcattcctccatagcc

SEQ ID NO: 115115 - DNA, 201 bp, Bos taurus; identical to SEQ ID NO: 73712

SEQ ID NO: 115116 - DNA, 201 bp, Bos taurus
gcgctgactccccacgcaggactgccttctgagtaggctcccttgtcactagagtattcacccctggttttagttattctttaatagaggaaaggttgcayatgcagagcatttacagatagcatcattacaaaatggagttcaggttcaagctggttcaagcaggttcaatctgagtttcaagctcaggaaaaataagta

SEQ ID NO: 115117 - DNA, 201 bp, Bos taurus
tggccaatacctcttctaagctcttaaatcttgtcactcatcaacctacatctttccaaactgctttcactacacaagatacattttccatctggtaggartggccctttcactagctgagggaattgactcaccacttgttcaacagagagacacttgctgttgacttgaggagacagggcggccggtcaatgaagaaaa

SEQ ID NO: 115118 - DNA, 201 bp, Bos taurus; identical to SEQ ID NO: 73713

SEQ ID NO: 115119 - DNA, 201 bp, Bos taurus; identical to SEQ ID NO: 73714

SEQ ID NO: 115120 - DNA, 201 bp, Bos taurus; identical to SEQ ID NO: 73715

SEQ ID NO: 115121 - DNA, 201 bp, Bos taurus; identical to SEQ ID NO: 73716

SEQ ID NO: 115122 - DNA, 201 bp, Bos taurus; identical to SEQ ID NO: 73717

SEQ ID NO: 115123 - DNA, 201 bp, Bos taurus; identical to SEQ ID NO: 73718

SEQ ID NO: 115124 - DNA, 201 bp, Bos taurus; identical to SEQ ID NO: 73719

SEQ ID NO: 115125 - DNA, 201 bp, Bos taurus; identical to SEQ ID NO: 73720

SEQ ID NO: 115126 - DNA, 201 bp, Bos taurus; identical to SEQ ID NO: 73721

SEQ ID NO: 115127 - DNA, 201 bp, Bos taurus; identical to SEQ ID NO: 73722

SEQ ID NO: 115128 - DNA, 201 bp, Bos taurus; identical to SEQ ID NO: 73723

SEQ ID NO: 115129 - DNA, 201 bp, Bos taurus; identical to SEQ ID NO: 73724

SEQ ID NO: 115130 - DNA, 201 bp, Bos taurus; identical to SEQ ID NO: 73725

SEQ ID NO: 115131 - DNA, 201 bp, Bos taurus; identical to SEQ ID NO: 73726

SEQ ID NO: 115132 - DNA, 201 bp, Bos taurus; identical to SEQ ID NO: 73727

SEQ ID NO: 115133 - DNA, 201 bp, Bos taurus; identical to SEQ ID NO: 73728

SEQ ID NO: 115134 - DNA, 201 bp, Bos taurus; identical to SEQ ID NO: 73729

SEQ ID NO: 115135 - DNA, 201 bp, Bos taurus; identical to SEQ ID NO: 73730

SEQ ID NO: 115136 - DNA, 201 bp, Bos taurus; identical to SEQ ID NO: 73731

SEQ ID NO: 115137 - DNA, 201 bp, Bos taurus; identical to SEQ ID NO: 73732

SEQ ID NO: 115138 - DNA, 201 bp, Bos taurus; identical to SEQ ID NO: 73733

SEQ ID NO: 115139 - DNA, 201 bp, Bos taurus; identical to SEQ ID NO: 73734

SEQ ID NO: 115140 - DNA, 201 bp, Bos taurus; identical to SEQ ID NO: 73736

SEQ ID NO: 115141 - DNA, 201 bp, Bos taurus; identical to SEQ ID NO: 73737

SEQ ID NO: 115142 - DNA, 201 bp, Bos taurus
cagccaaagtcgtggctcatgggggctgcagtgaaggtatgcgtggaaaaaaaaggcgtgaaccaggagaggatctgtgaggagctggggccttgctttgmgaaccagcaaagcaagaggcagagggaggatctggggaacttctgcagtgtcctgttggaaccagccgaggcatcaataggtagtcaggctatctcaggg

SEQ ID NO: 115143 - DNA, 201 bp, Bos taurus
caattagaactctgagatagtaatgtttaatataaacacaatagagtccagaaacaggcccacatacaaatgggaatttattataccaggtactcattaayaataaagaccttatactggcacaaaaacagacttgtaggtcaatggaacaaaataaagagcccagaaataaacccacccccctacactcagttaagctga

SEQ ID NO: 115144 - DNA, 201 bp, Bos taurus
gcttgcgctggcaggcagaccatctttgtttttcattagtgtgtgttgtcgtcacagtaactgcaagcctccaaatacaggcccgggctgtcatttcctcrtgtacttaggctgccacactgaaatagcattatgaactcagcaatgcctcttcctttcctgttgtgctgtggtgcctcagtcaaagaagcaggccctaaa

SEQ ID NO: 115145 - DNA, 201 bp, Bos taurus; identical to SEQ ID NO: 73738

SEQ ID NO: 115146 - DNA, 201 bp, Bos taurus
atcaatatagaagaaaggtagggccctaagacatgcaagttaaggttttccttcattaaaaaaccaaagagcaagcatacctcttgcttcacaatctgggyactttagtttcctcacagaacaaaacttttgctatgcctaagagatttttctttttttagtgtaacccacacctaagctaacttacatccttccagaagt

SEQ ID NO: 115147 - DNA, 201 bp, Bos taurus; identical to SEQ ID NO: 73739

SEQ ID NO: 115148 - DNA, 201 bp, Bos taurus; identical to SEQ ID NO: 34128

SEQ ID NO: 115149 - DNA, 201 bp, Bos taurus; identical to SEQ ID NO: 34129

SEQ ID NO: 115150 - DNA, 201 bp, Bos taurus; identical to SEQ ID NO: 34130

SEQ ID NO: 115151 - DNA, 201 bp, Bos taurus; identical to SEQ ID NO: 73742

SEQ ID NO: 115152 - DNA, 201 bp, Bos taurus; identical to SEQ ID NO: 34132

SEQ ID NO: 115153 - DNA, 201 bp, Bos taurus
gactggaattatttcttttttacatagataatataaggcaaatgtggtgactgagctgatgaagatcaaagctttgattgaggctttgttgtctcaaatakcgtttaacaaaatctgctgtatttgccctggatacatatattcttccattatttttttcacgtgtgtgtgtgtgtagaaaagttagcaatactcgttaaa

SEQ ID NO: 115154 - DNA, 201 bp, Bos taurus; identical to SEQ ID NO: 73746

SEQ ID NO: 115155 - DNA, 201 bp, Bos taurus; identical to SEQ ID NO: 73747

SEQ ID NO: 115156 - DNA, 201 bp, Bos taurus
tgagaaactggaatttttgttggagaacttccatactttagttataaaatcacggtactattatggaacattttcacctttttttcccccaagtgttcaayaataagaaagtagcagggtcttttacttcagaacaaatatgaatatatgtaagatcatgttattgaatagtcaaaggactgctatggagactaaagaata

SEQ ID NO: 115157 - DNA, 201 bp, Bos taurus
tgtttctatttcttcctgatgaaaagaaagtattcgtcatcacccagagttgtgaacaaactaattcaaggagggtaaaatgcagatactttctgacataygaaggatcatcttaattacaggttgcctgctttctcattcaaattgaaaagttgaatggaatggtatgaatcacttattatacttgtttattactagact

SEQ ID NO: 115158 - DNA, 201 bp, Bos taurus
aaaaataaaacagaaaaataattagtttctagtgactgtcattttcatgcaaaaaatatagctaccctactatatgttttattgttatatttattgttgtygttctggtatggctgaatcctatattggctctctaaagtgttgtttatcctacacaggctagggagttgctgtccatggtatttctattccccggaagtg

SEQ ID NO: 115159 - DNA, 201 bp, Bos taurus
caaatttagctgggcttctctccaaagctagtgtttgacttttcgaatgatctgcctctggacgccaaccagagcagagatgctgcttcagccagtcctgrataatgtcctcagcccagtcctagcacagacggactgcggtaaatattcaaaactacactgtagttacacatgtcacattcaaatggcagaagaccatgt

SEQ ID NO: 115160 - DNA, 201 bp, Bos taurus
gtgcagcacacgactttaacatttatttttattttgaaatgtcttaaatcccgcacctgcattcgaatcccttgggagctgtgaaaaattctgaggcctgsgttgcactccagatgagcaatgtcagaatctccgggggttgaactgaggtatccatattctttgactgtccctccgttattctgaagtagggccaggatt

SEQ ID NO: 115161 - DNA, 201 bp, Bos taurus; identical to SEQ ID NO: 34136

SEQ ID NO: 115162 - DNA, 201 bp, Bos taurus; identical to SEQ ID NO: 34138

SEQ ID NO: 115163 - DNA, 201 bp, Bos taurus; identical to SEQ ID NO: 34139

SEQ ID NO: 115164 - DNA, 201 bp, Bos taurus
tctgaactttaatttttccctggagttaacacagttggaaagaagttaatattcaaatttggaagtgccctataatgttgatattttattactggggtgawttaatgctgtcattttatacttaactgcagaacctctaatgcagctagctggaattctgagtggaaatgaatgaacttaaatcttgtgaaaagaacagcc

SEQ ID NO: 115165 - DNA, 201 bp, Bos taurus
aaaaagaaattgaaatacttccaaaagcaattttctcacttaaaacctgaaaagctctgcttttctccattcaacaagttaaaagaaaacagtaacaaacycaaagagattctttgaacgccagatatactgaaggatgaggttctaaagataaaaggtaataagcttacatatgctcagacttttccctatcaccacttt

SEQ ID NO: 115166 - DNA, 201 bp, Bos taurus
gaaagaagaatgcagaaggtgagaaaagtttctaggtaaaagaaacagaaacttgtggtctgacaaagaaattctttatagactaaaaaattgacattcayaggatttatttaacctaatactcaagaataaattcaacaaactctttttaaaacttggcttaaaacagaatcttttagccagattacaaaacaactcctc

SEQ ID NO: 115167 - DNA, 201 bp, Bos taurus; identical to SEQ ID NO: 34143

SEQ ID NO: 115168 - DNA, 201 bp, Bos taurus; identical to SEQ ID NO: 34144

SEQ ID NO: 115169 - DNA, 201 bp, Bos taurus
atgaaatactcttggcttcctgggcagaaatgagtacatcaacacttcaggctatgacaatgcatattatccattatggataaaccaattaaaaagggcckgattaccaaatgtaagacaatgaaaggcagtgctcttcaagtaaacataagtggttactagtgtacatggccggagaaggcaatggcaccccactccagt

SEQ ID NO: 115170 - DNA, 201 bp, Bos taurus; identical to SEQ ID NO: 73756

SEQ ID NO: 115171 - DNA, 201 bp, Bos taurus; identical to SEQ ID NO: 34154

SEQ ID NO: 115172 - DNA, 201 bp, Bos taurus; identical to SEQ ID NO: 34155

SEQ ID NO: 115173 - DNA, 201 bp, Bos taurus
gatattgaatggacatcaaacacaaatactactatgaatataggcatccactacccaagcactcagaaagcataagggcataatggaaaagcagcaatacrgtaataacatgtctttttgagtatcccagatttctagcacatatctgagtgccgcttcatgtgaaaatgaaaactagagagagacctacctgggatacgg

SEQ ID NO: 115174 - DNA, 201 bp, Bos taurus
gcagcgtcccgtgcacttaatcaccgaccactacctccatctaccccactggaacacatcacagagatgaggtgggggtctccttattcattaaaccctcyttgtcaaatacccactctgagaagccttcgggtgaatacactctcctagtatcatgttcatctgaattaatcattgtcacccaaggactcttccagtcat

SEQ ID NO: 115175 - DNA, 201 bp, Bos taurus
tactgttgaggtgtgcagagcaagaaagtttctctggggaaactgctcagtgaagagagagagaaaaaaaaaagtaagagttaactgctagagcagcagcracagacctacccttcttgctcctgaatctgcactgtcagatgatttctagtgctttcctagaaaaagaagaacatgctctgctgttgggcatgaaacaat

SEQ ID NO: 115176 - DNA, 201 bp, Bos taurus; identical to SEQ ID NO: 73779

SEQ ID NO: 115177 - DNA, 201 bp, Bos taurus; identical to SEQ ID NO: 73780

SEQ ID NO: 115178 - DNA, 201 bp, Bos taurus; identical to SEQ ID NO: 73781

SEQ ID NO: 115179 - DNA, 201 bp, Bos taurus; identical to SEQ ID NO: 73782

SEQ ID NO: 115180 - DNA, 201 bp, Bos taurus
gtcagcaccctcagcaccgcttcttctctgcaagcacagcagtcattcttacaggcatgggcaacacgtgctgaggggcctgtctgctgttcccttagtgygtcatcacctggcacctctatggagcttgcctaccagtcctgatgccttctgtgcccctggactttatgaggccgtactctgagggcacagcttccctct

SEQ ID NO: 115181 - DNA, 201 bp, Bos taurus
gaaggagaaactgtgctaactagcccaacttctctcttgggagagctgcctttgcaagcgatgctctcagactctctgagccttgaggtaacctagaagcraaggtgctgtcctcttggagaaggcctgcagtggtccagagctgcccgtgactgatggggagcatctcccaaatcctggggcacagttccagctccctgg

SEQ ID NO: 115182 - DNA, 201 bp, Bos taurus
aaggagtttctactgtatatgaaaatgagatttgtacatctgcagtctgagtttggacttctggcttaactacattattataactcgagacttctgtattrctgttgttgttattgaactttttctgggacattcagatatacaattaaaatatatgtgacggaagaatcaaatctataagcagttattggagaatgatga

SEQ ID NO: 115183 - DNA, 201 bp, Bos taurus
tccagactcagcccgtcagtgtctcactctcctgagccaagggcactggcattgcaccaaatcaggtgcacctgctccagctagccatggccagagccagratcatggagagaggggaagtcactcctgcagcggtggttgtggcggcaagatcaggctccctggccgcagaggcggtgtgtggagctctgggccagcagg

SEQ ID NO: 115184 - DNA, 201 bp, Bos taurus
gcactggttttatgggttggactgcctgtgaacatgattcagaattcagactgagaaagaaaatatactcccaggcttccaactgacaacactcttttttycttagttgcttttttcttggagtagagttgaattggaattctggtatacaggttgcattagtttctggtatacaacaaaatggctcagctatacctacac

SEQ ID NO: 115185 - DNA, 201 bp, Bos taurus
cttaaagagacaaacaagcctttccattctatggtaggagagctgccaggaatattctgccacagtactcatgactgtgatcttgttctttcatcagccaratgaaaatacataaaatcctgggaaaatcaggacattaaaaaccaataggaccactgtctattgagaagtcacaaccaaacagagatctgcccccttatt

SEQ ID NO: 115186 - DNA, 201 bp, Bos taurus; identical to SEQ ID NO: 73785

SEQ ID NO: 115187 - DNA, 201 bp, Bos taurus; identical to SEQ ID NO: 73786

SEQ ID NO: 115188 - DNA, 201 bp, Bos taurus; identical to SEQ ID NO: 73788

SEQ ID NO: 115189 - DNA, 201 bp, Bos taurus; identical to SEQ ID NO: 73789

SEQ ID NO: 115190 - DNA, 201 bp, Bos taurus; identical to SEQ ID NO: 73790

SEQ ID NO: 115191 - DNA, 201 bp, Bos taurus; identical to SEQ ID NO: 73791

SEQ ID NO: 115192 - DNA, 201 bp, Bos taurus
cctgtttcttgctgttttcattttctcatatctttatttctagtctttctgtaacatttctttttcaatatgcaacatggtctgcttgtactttgtgaaayaacccaaaaataattttattagcaggtgagttaatcttcattcatatttattgataatgaccaatcttctcttaattctgtcattatgttatacttaaca

SEQ ID NO: 115193 - DNA, 201 bp, Bos taurus; identical to SEQ ID NO: 73792

SEQ ID NO: 115194 - DNA, 201 bp, Bos taurus
atggtgtgcgggaaggggctgcaattactggaagtggccaccttcttttgtgactttctactttcgtgcctttttagttgacgtcaatttacccgcaaaastacgatcatccttggccaacagtgaagtggggacagatctgggacaatagtacaaccctgacagagcccttgagaggtcctgccattcgtcactccaaac

SEQ ID NO: 115195 - DNA, 201 bp, Bos taurus; identical to SEQ ID NO: 73793

SEQ ID NO: 115196 - DNA, 201 bp, Bos taurus
cctttttttttcccttctgatagtccatggtccttcagatcttctgaattttctggaattgagttcggtattttgcttttcaagtttctggcttacctaartttcactgtgctaattatggaaagggggttccaatctaacaacatttaagcactaataacaagcagtatgctaggaagggagcagaagagatctaaagtg

SEQ ID NO: 115197 - DNA, 201 bp, Bos taurus
ggcccccatccttgaccccaataagagcagttctccaggtccattctctctctttctcttcctctatccttcaaaggacttcaccatgaggcccaggggtrccatgtgctctccaggaaccatggataataaatctcccctccccccaaactttcctgatggttattgctgaagggcctcttacagtagtaagaagaacca

SEQ ID NO: 115198 - DNA, 201 bp, Bos taurus
ggggacaggaagatacgcaaagttatgattcgtccttttcttcccctccatgcagctgcattaaagaagtcatggactggcccttcttttaaggatgctcytcaccccacccttctacgtctttggaccttatttgatgtttcaaataattactaatttctatttttggttatctatgaaacaatgatggccaccatacaa

SEQ ID NO: 115199 - DNA, 201 bp, Bos taurus; identical to SEQ ID NO: 73795

SEQ ID NO: 115200 - DNA, 201 bp, Bos taurus; identical to SEQ ID NO: 73796

SEQ ID NO: 115201 - DNA, 201 bp, Bos taurus; identical to SEQ ID NO: 73797

SEQ ID NO: 115202 - DNA, 201 bp, Bos taurus; identical to SEQ ID NO: 73799

SEQ ID NO: 115203 - DNA, 201 bp, Bos taurus
atcttgttgggtttcttaactaccttttaaaagaagccacatgccaagaaccatcttcaagccatagaatcagaatgagtgagagctaaatggaaccttamatatcatccatctggatccaccagtttctgaggaaactgaagtctgggtctcagtaagccactagcagatcccatatcatctggctctggggacattttc

SEQ ID NO: 115204 - DNA, 201 bp, Bos taurus
agccagggatctggcaagcgctgttctattactaacagcataagtctgcttcagggcaagccagacactccaggactttgactaccattttcatctaagtrgaaaagacatggttcacaaaatgtttcacataataggttcagtacgtttatggtccacatagatatatgtaaatatcacacctatgaacagtacactctg

SEQ ID NO: 115205 - DNA, 201 bp, Bos taurus
ggcaaggagtcagatacgactaaaacgacttagcacagcgcagaagaaacctgcctcagaaacggtgtggatggaggcagggtttttacatcctgttcccyccctcactactttagtgaagctgacttcctcaaacttgacctactgtgaagaaactcaacagtatctcatgcatcatttgtcttgaccactgacagcccg

SEQ ID NO: 115206 - DNA, 201 bp, Bos taurus
tagttaaatgaattagctatgacgcagaagtttccaaactctgtgctcaaactttatgttagaaatacctgacggaattgctggttaaagactatggtgarggtttccctgatagctcagaggtaaagaatccgcctgccagtgcagaagacacagattcaatccctgacctgggaagatcccacatgccgtggagaaact

SEQ ID NO: 115207 - DNA, 201 bp, Bos taurus; identical to SEQ ID NO: 73802

SEQ ID NO: 115208 - DNA, 201 bp, Bos taurus
ttgaaattgacatgcatttggggactctcatccacaagatagaaaacctttggcctcacttctgttatttctgtaatcgtctctcataccctcattgtccytgattgtgtctagtgtgctgcaggccacaacataagtactcctgaataaatacatataaataaagacacttacttatttaacatacacaactgctctcct

SEQ ID NO: 115209 - DNA, 201 bp, Bos taurus; identical to SEQ ID NO: 73805

SEQ ID NO: 115210 - DNA, 201 bp, Bos taurus; identical to SEQ ID NO: 73806

SEQ ID NO: 115211 - DNA, 201 bp, Bos taurus; identical to SEQ ID NO: 73807

SEQ ID NO: 115212 - DNA, 201 bp, Bos taurus
tcctgcagagcctgtgagtgccgtgtcacctcctgcaggttcagagatgatcatgcttgagtcggagaacaggtggtcgtcgagcaccaccatgggcagtragctgaaggtcacgaatagctcctggccctcattgtccaggctcaggctaacgagggccgtgagcgtcagccagtggttgtagctggcctccttgaggca

SEQ ID NO: 115213 - DNA, 201 bp, Bos taurus
gcccagaggtttgcatcttcccatacatagaatgcgaaattgcttaacgtgacacctgatctttgatgttcagactgcctgctccctttgttgcaaagttktatgtggcctgactcctctgctcctgcctccttgcagcagttttctcagagctactgagatgctgtctcctaggcttggagtcctaaacgttcccaccaa

SEQ ID NO: 115214 - DNA, 201 bp, Bos taurus; identical to SEQ ID NO: 73810

SEQ ID NO: 115215 - DNA, 201 bp, Bos taurus; identical to SEQ ID NO: 73812

SEQ ID NO: 115216 - DNA, 201 bp, Bos taurus; identical to SEQ ID NO: 73821

SEQ ID NO: 115217 - DNA, 201 bp, Bos taurus; identical to SEQ ID NO: 73822

SEQ ID NO: 115218 - DNA, 201 bp, Bos taurus; identical to SEQ ID NO: 73823

SEQ ID NO: 115219 - DNA, 201 bp, Bos taurus
gatttaactttgatgttcactggtctaaagctgacctgtatgcataacaggaaatgaaaaataagacagggtggtagtcaccatctcttctttcactgcasgtggtcagcacttattctgagccctcctaatacatttgctgcttcctatgcctgtgtttgtgtgtctcatttccgctgctacaacttttttaagaaaagc

SEQ ID NO: 115220 - DNA, 201 bp, Bos taurus
agatcagctttatataagaatttgcaaaagtattacatggggtaacagagaacacaggtagtggagtgaggtgcagagagctggggtgagaatcaacaagygctgtctgggataacttgaaatcaagctgcttaaaatgtcaaggacctcctgggagcaccctatggttacaattaactctggaggggagaaagctaaggc

SEQ ID NO: 115221 - DNA, 201 bp, Bos taurus; identical to SEQ ID NO: 73824

SEQ ID NO: 115222 - DNA, 201 bp, Bos taurus; identical to SEQ ID NO: 73827

SEQ ID NO: 115223 - DNA, 201 bp, Bos taurus; identical to SEQ ID NO: 73828

SEQ ID NO: 115224 - DNA, 201 bp, Bos taurus
cactgcaaagtaatgattgtcaagtgaccaaggaaaaatcacaaatctactgtatgtctagctgtcacttgattattctaaacctccaggttcatgtactsaaatcacagcaaagttatttgctactccagagaagtattatgaaattttaaacctctgggactttacacaaactgctccttctattgataatgccctgtc

SEQ ID NO: 115225 - DNA, 201 bp, Bos taurus
atcctttaaatagctgcttcctttgtgcactcatggcctctctaaggtgacagaacacggttacatgaagcgtagaatgaaagaatgaaatagtgcccccmaaataaggccttatttattactgaaggcaaaatattgaattacgggaaaagaaataggtaaccatctcacaaacaagccaatgttattcatttggaatac

SEQ ID NO: 115226 - DNA, 201 bp, Bos taurus
atcagggacttttgagagtccttttaattactttcaccaagatctctgttcttttcaacaatgcccttaggcatagaattcttcacaatctgttgcacacraagtcagtttccccagggagaactataaagctctttgtctttaaggcctgcctctccctagggcaaaacctctgtgatgctgcaaaggagttggaggcag

SEQ ID NO: 115227 - DNA, 201 bp, Bos taurus
accctatctgttcttttacagaattctgagagaatccagggcataatcaggagctatcttacaggttcctgcagagaaatactcatggcagtagaggcagrgggacactcagcaaagtctcagggcacacaagagtgtccttctgctggaaatttcccaaggattaggcagtcatccaacacgtccacagacactggcttt

SEQ ID NO: 115228 - DNA, 201 bp, Bos taurus; identical to SEQ ID NO: 73829

SEQ ID NO: 115229 - DNA, 201 bp, Bos taurus; identical to SEQ ID NO: 73830

SEQ ID NO: 115230 - DNA, 201 bp, Bos taurus; identical to SEQ ID NO: 73832

SEQ ID NO: 115231 - DNA, 201 bp, Bos taurus
taaaccaaatatttgtataaaagcttatttgatgactgcaaataattggagacctttatctgggttcgttcattcattgctttacataaaaaatgtttacygatggcctacaatacacagaacactggaaaaatacagaggttgaaaatgtaagacttgtttctttgtatactaggttaacaaattgagaaaataattaaa

SEQ ID NO: 115232 - DNA, 201 bp, Bos taurus; identical to SEQ ID NO: 73833

SEQ ID NO: 115233 - DNA, 201 bp, Bos taurus
aataggtgcaaagtttatgcccagggcttataatttgagagagaaggaagataggatgaaaactaatatgtaggaaaatcataatgataaccttttataarggtgctaaaaatgtagaggttacagatgcagttgcttaaatgcaacacatcctccaaaaaacgctgagctgagtctttcaaaaaatgagaaggacactga

SEQ ID NO: 115234 - DNA, 201 bp, Bos taurus
aagttttgtctgattgactctcagtagattttggagtggttgtgaatgatgcaaagctggaaactgccagctttacttcattcacttcatccacttcattyacttcatctaatggcattagatggtagaggttgaagtcaggcagcaggtgtggacagtcagtcagatggacgagtttccacagtgtctccctcataaagt

SEQ ID NO: 115235 - DNA, 201 bp, Bos taurus
aagatctactggaagcccttctctaaggccccagtgttggggaaaactatgctacttttgaacagtgtaggatgacacaggagaccttcagcagactgtgrtatcttctttgcttggccagtaaaaaactcagaatgaaatttgcaatccagttctgcaatgttccataaacttattgtatgatttatttttatctattta

SEQ ID NO: 115236 - DNA, 201 bp, Bos taurus
gaatgactaaaacataacatgtaagaaaatatttagctaatataaaaatttaaaattaagtgccaggcataggtacctatgattcagaatgttactaattmatttgcaatcttgctaaagttattattttactgagcatgtgtgtggcatgatttccacattgtgaatttgattgctgttgttatattgggtgggtccaag

SEQ ID NO: 115237 - DNA, 201 bp, Bos taurus
tttcctgcataggcaggcgggttctttaccactagtgcagcctgggaatccccttatataggagagggggtcaataaatattaatcccattcctcaggccmctcccccttgtcaacctctgctgacattgtctttaacaaatatatttttgtatatattttctcctctgatggagatatattctacattattaggggccac

SEQ ID NO: 115238 - DNA, 201 bp, Bos taurus
aagtgtctgtgcccctgctcacttcccgctcgctcctcacccggtccggactggctcctcttgttactagtccacagactcggcctcagcctccagtgacsttctggttgctggacttgggggatcttgtcttcctgtggtactgacttgtgtctgattcacaagcatctcttcggttctctcacactttcctcctgtctc

SEQ ID NO: 115239 - DNA, 201 bp, Bos taurus
ctctgtctgcatgtcatctgctgccactgtctcccttctttttttacagccatactggactccttggagtggagtttctggaccacacgcaccaagcttartccatctcagggcctctgcatcttccagtgcttatggaattcaccttccccagatctacatggcttgttcctcaatttgttcaattctctgctcaaatct

SEQ ID NO: 115240 - DNA, 201 bp, Bos taurus
atcctcacacattttgcagaaatgagttacaataaaccccagggctgggctttcccttcctctgacctctgtgttatttatcaggcagaggctgcaaaatmtcccacttcatactctgaaaaaccatgctcacagtaataataacctctgtctgtccgtgtgtcctgtctccttaggaatgttaatttacaaagagtaaag

SEQ ID NO: 115241 - DNA, 201 bp, Bos taurus; identical to SEQ ID NO: 73841

SEQ ID NO: 115242 - DNA, 201 bp, Bos taurus
attccttccacttattcaaactgagagttgagtttctgtttcattacctcagagaaaagatgacagggccaatgcagaattagcttgcaaatctttctggmttttattttcccaaagcttcataccttaggagtaattagcagatgagataaaaggaagaaaagattttccagtatatgcagaaccttggatatctacagg

SEQ ID NO: 115243 - DNA, 201 bp, Bos taurus; identical to SEQ ID NO: 73842

SEQ ID NO: 115244 - DNA, 201 bp, Bos taurus
tatttgtccactgaggcctcttaggttgtttccatattgtggctatcatgaataatgctgtaatgaacatgggagtgcagatatatctttgagatactgayttcattccttctgaatacatactcagtgtgggattgctggatcatattgtagttctatttttaatttcttgaggagcctccatattgtcatatggttttc

SEQ ID NO: 115245 - DNA, 201 bp, Bos taurus
ttgcgggctgtacaaggtgggaacccccaggggcaggaggcactgagtcttggttcacggctcacctgagctatgcccttggtcactaggtcattttggcytgaggaactgcctccagttccctgagcaatcaaatccatttatatgagagactgcatgacggcatttcagttccaagaatcagcagtgagcgctaaggga

SEQ ID NO: 115246 - DNA, 201 bp, Bos taurus; identical to SEQ ID NO: 73844

SEQ ID NO: 115247 - DNA, 201 bp, Bos taurus
cctttcctcattgataaaccttcaatttcccaatagattaattcagctacaattcaacagtttcttgtctgtaaggttgacgtaacatgatagaatattartaaatggtgagacatcattttctagttaatatcctttgtcagcaaagtggggaaggtaagaagatggtaaacatttttttttttcacttggcaaatcaga

SEQ ID NO: 115248 - DNA, 201 bp, Bos taurus; identical to SEQ ID NO: 34157

SEQ ID NO: 115249 - DNA, 201 bp, Bos taurus; identical to SEQ ID NO: 34158

SEQ ID NO: 115250 - DNA, 201 bp, Bos taurus
tcaaactagggtatgaaatctatgacacgtgtacagacatcacagtggcaatggcagctgctctgaggtgtgtttctaagttcaacagctccagagaaatygtggagtttaagtgcgactattccaactacgtgccaagggttaaggctgtcataggtgctggctactcagaaatatccatggctgtctcccggacgttga

SEQ ID NO: 115251 - DNA, 201 bp, Bos taurus
ataatttagaaaacaatagtggaaatattagtatttccttctttttaaaagaattagatgcactactggacatgcttatgtgtttactaacttttcttatmcctttccttttatcctgtagtccttaggtgattttctgggaatttgtcctcaaatacaccttttctgtatattgtctgtcctttactgtgtgcgtactga

SEQ ID NO: 115252 - DNA, 201 bp, Bos taurus
aaataaaagcctggagattgagcatcagtcttctgagaatggtctaaaagattttactaagcattccatgacaaacaaaactgttgctatagctttcaaaygcatccttttgtgtgcagtacagtttgtcgaagttaagtaaatatgactcctggttacatgtagacctctttaatatctccaacacttttgaccactttt

SEQ ID NO: 115253 - DNA, 201 bp, Bos taurus
ggtggccatggttcaaagcctttcacggtgcagtgcacaggcagtcaagcagttggttggagctgcagtctctgaagacttgactaaggctgggaatctayctccaagctcactcactggcctcagtgccttgctcacagctggccagagacttcctgaagttccttgtcacataggtccctgtagtgctctaatcaccac

SEQ ID NO: 115254 - DNA, 201 bp, Bos taurus; identical to SEQ ID NO: 34162

SEQ ID NO: 115255 - DNA, 201 bp, Bos taurus; identical to SEQ ID NO: 34163

SEQ ID NO: 115256 - DNA, 201 bp, Bos taurus
gaaaaatcaccaggggagcaggtagaagagggagcaaagatgcagcaggaaagaggaccctgggcctcaggggcagctggtggcttggtgaacctgatcayagtgtgtctgtgcaggagcaaaggaccgtgaggtccaagaaattaccagaatcttgtgtgccctgctaaagacattagattctattccaaacatgttttg

SEQ ID NO: 115257 - DNA, 201 bp, Bos taurus
cttgtcgctgttgagtgaaaaatgaatgagtggataaattttatgctggtagactgtagttataactttgtcaccagttcttgtgtgaacctgaaaaaaaycacttaaacttactgaggaagatgagtattttctgtcataggcatcattgataatttaaagaaatgatggattcatgtcccagaaaaatgcatatactca

SEQ ID NO: 115258 - DNA, 201 bp, Bos taurus; identical to SEQ ID NO: 34164

SEQ ID NO: 115259 - DNA, 201 bp, Bos taurus; identical to SEQ ID NO: 34167

SEQ ID NO: 115260 - DNA, 201 bp, Bos taurus; identical to SEQ ID NO: 34168

SEQ ID NO: 115261 - DNA, 201 bp, Bos taurus
gttttctttagatggcatatcatatatgtttggatcttgcttttttagtcaatattgaaatctctgtattttaactgttgtgcttagtctagtcatataaygtgattactgatgtgattggacagaggagcctggcagacttcttggtgtccaggagttcacaaagagtcagacaggactgagcacacatgcatagagaca

SEQ ID NO: 115262 - DNA, 201 bp, Bos taurus
tattaaagttgctatggtttacttagagacttgacgcaaggaaatatttgaaaaggacaacaaagcgaaatgattatggaatgggcctcattaggctgttygctagaaagttttctggttaatattttgatccatctcatgatacatcataagtcattatggtatagaacatttagttatacttgtggcctcactttctct

SEQ ID NO: 115263 - DNA, 201 bp, Bos taurus
tcttggacttcactttctgccttgcctttctctctcctgcaataagtcctacatttttgcacctaaacttcccttaagcactggcctccagattttacacycatatcagtagaataacagctttggcgcgagggtgtctgacagagagctgctctccttctggccatcccaccaagtattagaatgaatcaaacctcaaaa

SEQ ID NO: 115264 - DNA, 201 bp, Bos taurus
actgaacaacaattctgctcaatgttgtttatgctcaccaagactgatctatccagtatacataacaggaaaaaatataatatgaaataagggatagaaakgccagtatgaaatatatcaattttcaagggcactggggaaattgaattctgactagaaaacaaaatgcttaacaccaagaagtgtcttaaattaatttta

SEQ ID NO: 115265 - DNA, 201 bp, Bos taurus; identical to SEQ ID NO: 73861

SEQ ID NO: 115266 - DNA, 201 bp, Bos taurus; identical to SEQ ID NO: 73862

SEQ ID NO: 115267 - DNA, 201 bp, Bos taurus; identical to SEQ ID NO: 34172

SEQ ID NO: 115268 - DNA, 201 bp, Bos taurus; identical to SEQ ID NO: 73865

SEQ ID NO: 115269 - DNA, 201 bp, Bos taurus; identical to SEQ ID NO: 34175

SEQ ID NO: 115270 - DNA, 201 bp, Bos taurus; identical to SEQ ID NO: 73866

SEQ ID NO: 115271 - DNA, 201 bp, Bos taurus; identical to SEQ ID NO: 34176

SEQ ID NO: 115272 - DNA, 201 bp, Bos taurus; identical to SEQ ID NO: 34177

SEQ ID NO: 115273 - DNA, 201 bp, Bos taurus; identical to SEQ ID NO: 34180

SEQ ID NO: 115274 - DNA, 201 bp, Bos taurus; identical to SEQ ID NO: 73869

SEQ ID NO: 115275 - DNA, 201 bp, Bos taurus; identical to SEQ ID NO: 73870

SEQ ID NO: 115276 - DNA, 201 bp, Bos taurus; identical to SEQ ID NO: 73871

SEQ ID NO: 115277 - DNA, 201 bp, Bos taurus; identical to SEQ ID NO: 73872

SEQ ID NO: 115278 - DNA, 201 bp, Bos taurus; identical to SEQ ID NO: 73873

SEQ ID NO: 115279 - DNA, 201 bp, Bos taurus; identical to SEQ ID NO: 73874

SEQ ID NO: 115280 - DNA, 201 bp, Bos taurus; identical to SEQ ID NO: 34181

SEQ ID NO: 115281 - DNA, 201 bp, Bos taurus; identical to SEQ ID NO: 34182

SEQ ID NO: 115282 - DNA, 201 bp, Bos taurus; identical to SEQ ID NO: 34183

SEQ ID NO: 115283 - DNA, 201 bp, Bos taurus; identical to SEQ ID NO: 34184

SEQ ID NO: 115284 - DNA, 201 bp, Bos taurus; identical to SEQ ID NO: 34185

SEQ ID NO: 115285 - DNA, 201 bp, Bos taurus; identical to SEQ ID NO: 34186

SEQ ID NO: 115286 - DNA, 201 bp, Bos taurus; identical to SEQ ID NO: 34187

SEQ ID NO: 115287 - DNA, 201 bp, Bos taurus; identical to SEQ ID NO: 34188

SEQ ID NO: 115288 - DNA, 201 bp, Bos taurus; identical to SEQ ID NO: 34189

SEQ ID NO: 115289 - DNA, 201 bp, Bos taurus; identical to SEQ ID NO: 34190

SEQ ID NO: 115290 - DNA, 201 bp, Bos taurus; identical to SEQ ID NO: 34191

SEQ ID NO: 115291 - DNA, 201 bp, Bos taurus; identical to SEQ ID NO: 34192

SEQ ID NO: 115292 - DNA, 201 bp, Bos taurus; identical to SEQ ID NO: 34193

SEQ ID NO: 115293 - DNA, 201 bp, Bos taurus; identical to SEQ ID NO: 34194

SEQ ID NO: 115294 - DNA, 201 bp, Bos taurus; identical to SEQ ID NO: 34195

SEQ ID NO: 115295 - DNA, 201 bp, Bos taurus; identical to SEQ ID NO: 34196

SEQ ID NO: 115296 - DNA, 201 bp, Bos taurus; identical to SEQ ID NO: 34197

SEQ ID NO: 115297 - DNA, 201 bp, Bos taurus; identical to SEQ ID NO: 34198

SEQ ID NO: 115298 - DNA, 201 bp, Bos taurus; identical to SEQ ID NO: 34199

SEQ ID NO: 115299 - DNA, 201 bp, Bos taurus; identical to SEQ ID NO: 34200

SEQ ID NO: 115300 - DNA, 201 bp, Bos taurus; identical to SEQ ID NO: 34201

SEQ ID NO: 115301 - DNA, 201 bp, Bos taurus; identical to SEQ ID NO: 34202

SEQ ID NO: 115302 - DNA, 201 bp, Bos taurus; identical to SEQ ID NO: 34203

SEQ ID NO: 115303 - DNA, 201 bp, Bos taurus; identical to SEQ ID NO: 34204

SEQ ID NO: 115304 - DNA, 201 bp, Bos taurus; identical to SEQ ID NO: 34205

SEQ ID NO: 115305 - DNA, 201 bp, Bos taurus; identical to SEQ ID NO: 73876

SEQ ID NO: 115306 - DNA, 201 bp, Bos taurus; identical to SEQ ID NO: 34207

SEQ ID NO: 115307 - DNA, 201 bp, Bos taurus
ttcattggaaggactggtgctgaagctgaagcttcaatactttggccacctgatgcaaagagctgacacactggaaaagaccctgaggctgggaaatattraaggcaagcagagaaagggccaacagaatatgagatgattggatggcatcactgactcaatggacatgagtttgagcaaagtcagggagatagagaagga

SEQ ID NO: 115308 - DNA, 201 bp, Bos taurus
ctagcgcccatgaaccacactgtattgatgggattcttaatgaactctctagcaacaatgcactggccttaataatttaggtcctgttaaatcgtgtctgyttctttactacatttggaactgctactgatctagaaaagagtcaatatcaaggggaagtattctctgcacttccagcatatgtccagtacatccaattat

SEQ ID NO: 115309 - DNA, 201 bp, Bos taurus
tacagggaaccttttctataagaccctgtaagtaaatataaacattgaaatacaataatattagggtcaagagtgaagccattcaaagtatgctttaataytagttttgagttacatgggtcagacatttggatcttaatatattactttacaggataattgctatctaaactttgtaaaatatttcaaattaatataatg

SEQ ID NO: 115310 - DNA, 201 bp, Bos taurus
tttggattgactggttttatctccttgaagaacaagggactctcaaagagtcttcttcagcacacatttgaaaagcatcaattctagtttaaagcatcaakcattctaatcaaagaaacataataactgctggactgggacttccttgacagtcaagtggttaagatttcatgctcccaatgcaggagacacaggttggat

SEQ ID NO: 115311 - DNA, 201 bp, Bos taurus
ttcagagcaaatatctctcaaagtattttttatatcaaattattaaatacagcccaaagtatttttttaaatcaagataattccctccttgagaactgtgyttataatgtttctgtctcatgaaaaaatgatcaaacaaaaatgatagtgaacaagaatgacattactatctcactgtctcacatatgataatgaaatcaa

SEQ ID NO: 115312 - DNA, 201 bp, Bos taurus
tcactttgggagttagggctttagtttatgaaacttcggaatacataattgcatccataatgtggaaataactgctccagatattggtgtacaggtttttrtgcgaatgtaagttttcatttctctgggataaatatccaagaatgcaattactcagtcatattataattacttgtttagttttctaagaaactacagtaa

SEQ ID NO: 115313 - DNA, 201 bp, Bos taurus
cattattctatacctaccattaatttcaaacttctccccataaatgtatgctttatcaagataaattgctattttataatattcatttggcttttcagtgrttccatggagcagtcacactttttcttacattatttcctcaattcagattatcccttctgcattctttcctaatatcagagatgcagtattcttttgaat

SEQ ID NO: 115314 - DNA, 201 bp, Bos taurus
ttcaatttgatgtggcttcagtattaccatttaactttagtaaattaactaagtagcttcagattcatagtattttgcaccttagatatgaatgccttaayctgtttcattatagtttgccaattaatgttatattgaaatacagatgctaaattttgtggttgatacagtttatttcaaagtgatcatgatatctctaat

SEQ ID NO: 115315 - DNA, 201 bp, Bos taurus
cacagctattatttttagactgctccagcgtcctctaacgggtgatgggaaaggctggcatgatgttgggagaggtgtgctctttgggaggcagaaatgaratttgagtctatcaggtccacttaggtagccttgtgttttattgtggtggttatttttttaatagctcctgtgaaagagtttagtgaaagaaatcattac

SEQ ID NO: 115316 - DNA, 201 bp, Bos taurus; identical to SEQ ID NO: 34210

SEQ ID NO: 115317 - DNA, 201 bp, Bos taurus; identical to SEQ ID NO: 34211

SEQ ID NO: 115318 - DNA, 201 bp, Bos taurus; identical to SEQ ID NO: 34216

SEQ ID NO: 115319 - DNA, 201 bp, Bos taurus; identical to SEQ ID NO: 73887

SEQ ID NO: 115320 - DNA, 201 bp, Bos taurus; identical to SEQ ID NO: 34221

SEQ ID NO: 115321 - DNA, 201 bp, Bos taurus; identical to SEQ ID NO: 34222

SEQ ID NO: 115322 - DNA, 201 bp, Bos taurus
ctgacctcagtagaagcagtaagttataaagggccgaacagaaaagccaagatgtcccttctgagagcttccatatccgcctatgtgataaaaaaggaggygatggagggctggcctgctaggaaaagaataatctttcatgttcatggagtgtcaaggtcaacctttctattcctgtccagcagattgtacaaaaagaat

SEQ ID NO: 115323 - DNA, 201 bp, Bos taurus; identical to SEQ ID NO: 34229

SEQ ID NO: 115324 - DNA, 201 bp, Bos taurus
atgttccaagggctctggaaaggacaccttgcagagactgatttttctcagaacagctgagcttcccaggtaactgtgggccactcaagccagccaccacytcattcctgctcccttatgtttctgtgcctggcatattgctgggaacatagctgctcctcaagaaatgacatctaaagaataaatggatcaggccgtaag

SEQ ID NO: 115325 - DNA, 201 bp, Bos taurus; identical to SEQ ID NO: 34230

SEQ ID NO: 115326 - DNA, 201 bp, Bos taurus; identical to SEQ ID NO: 34231

SEQ ID NO: 115327 - DNA, 201 bp, Bos taurus; identical to SEQ ID NO: 34232

SEQ ID NO: 115328 - DNA, 201 bp, Bos taurus
tcccttctccaggggatcttcccaaccctggaatcgaacccaggtctcctgcattgcatgaagattctttaccagctgagccacaaggaaagcccaatgaygagtaagagtggataattaagattcatagaagaaactaatcatgttataaacctattattttgaagagccttatcctatcatatcctttaccttaaagca

SEQ ID NO: 115329 - DNA, 201 bp, Bos taurus; identical to SEQ ID NO: 34234

SEQ ID NO: 115330 - DNA, 201 bp, Bos taurus; identical to SEQ ID NO: 73899

SEQ ID NO: 115331 - DNA, 201 bp, Bos taurus; identical to SEQ ID NO: 34238

SEQ ID NO: 115332 - DNA, 201 bp, Bos taurus; identical to SEQ ID NO: 34239

SEQ ID NO: 115333 - DNA, 201 bp, Bos taurus; identical to SEQ ID NO: 73900

SEQ ID NO: 115334 - DNA, 201 bp, Bos taurus; identical to SEQ ID NO: 34240

SEQ ID NO: 115335 - DNA, 201 bp, Bos taurus; identical to SEQ ID NO: 34241

SEQ ID NO: 115336 - DNA, 201 bp, Bos taurus
gtagaaggtagcaattggagttgagtcatcctgctgttttctctcagctggtagcatatgtctagcttcctcaggagcaagcctctacttcttttgctcarctacttctacatacaaataaaaaaaccattttggttgtaattagtgcttgccaagttttgccccagtcatttttggcacttctgataaccattgtttcaa

SEQ ID NO: 115337 - DNA, 201 bp, Bos taurus; identical to SEQ ID NO: 34242

SEQ ID NO: 115338 - DNA, 201 bp, Bos taurus; identical to SEQ ID NO: 73902

SEQ ID NO: 115339 - DNA, 201 bp, Bos taurus; identical to SEQ ID NO: 34243

SEQ ID NO: 115340 - DNA, 201 bp, Bos taurus; identical to SEQ ID NO: 34244

SEQ ID NO: 115341 - DNA, 201 bp, Bos taurus; identical to SEQ ID NO: 34245

SEQ ID NO: 115342 - DNA, 201 bp, Bos taurus
tttccataggaaaagtgagtaaatgacaaatcaaaacttgaggcagtattgaattcacgttttactgatttttggagaagaatgattttattattttttaycatgtgaaaatgattatgggtctttttggaccaaaagactaataatgttgtatctagcacagttttatattccagcttaatgtctatgtctgctctaaac

SEQ ID NO: 115343 - DNA, 201 bp, Bos taurus; identical to SEQ ID NO: 34248

SEQ ID NO: 115344 - DNA, 201 bp, Bos taurus; identical to SEQ ID NO: 34250

SEQ ID NO: 115345 - DNA, 201 bp, Bos taurus
ctgctgcatctaccactgcaatgttcatttggtgtatgtgtgtttgtgtgttcatgctggagtatccaccttctctggggggaggggacggtgtgatgggrtaagatggggagggaaaaggccaagacattatgtcttcattgcagcttacgaaaaagataggaacatccacccagttggtctctatggacttacctgtag

SEQ ID NO: 115346 - DNA, 201 bp, Bos taurus; identical to SEQ ID NO: 34252

SEQ ID NO: 115347 - DNA, 201 bp, Bos taurus; identical to SEQ ID NO: 34253

SEQ ID NO: 115348 - DNA, 201 bp, Bos taurus; identical to SEQ ID NO: 34256

SEQ ID NO: 115349 - DNA, 201 bp, Bos taurus; identical to SEQ ID NO: 34257

SEQ ID NO: 115350 - DNA, 201 bp, Bos taurus; identical to SEQ ID NO: 34258

SEQ ID NO: 115351 - DNA, 201 bp, Bos taurus
atcaccaaggaagtccttcataactgcttaatgctgacagatcatcctctgactcctcataatgattagcaggaaattcatttgggtaacactgacttttyatggttcactgatggttcatatttaaaatgtgacaatggcaaatattatgctggatatgctattacaactccttttgatgttattggagcagcaccttta

SEQ ID NO: 115352 - DNA, 201 bp, Bos taurus; identical to SEQ ID NO: 34260

SEQ ID NO: 115353 - DNA, 201 bp, Bos taurus; identical to SEQ ID NO: 73912

SEQ ID NO: 115354 - DNA, 201 bp, Bos taurus; identical to SEQ ID NO: 34261

SEQ ID NO: 115355 - DNA, 201 bp, Bos taurus; identical to SEQ ID NO: 73913

SEQ ID NO: 115356 - DNA, 201 bp, Bos taurus; identical to SEQ ID NO: 73916

SEQ ID NO: 115357 - DNA, 201 bp, Bos taurus; identical to SEQ ID NO: 34266

SEQ ID NO: 115358 - DNA, 201 bp, Bos taurus; identical to SEQ ID NO: 73918

SEQ ID NO: 115359 - DNA, 201 bp, Bos taurus
cgagttggtagacttgccacacacagtattcaaggttactgattttcaacagcactaacaaaatgctattacaggggaaatatcgtatgcactggatggayaaccacaaaaaaggtgaaaagtgacccacagcagttagctcagtaagaatataaaaataaatatgttttaaaagctaaggcaatgaggtaaaattccctg

SEQ ID NO: 115360 - DNA, 201 bp, Bos taurus; identical to SEQ ID NO: 73919

SEQ ID NO: 115361 - DNA, 201 bp, Bos taurus; identical to SEQ ID NO: 34268

SEQ ID NO: 115362 - DNA, 201 bp, Bos taurus; identical to SEQ ID NO: 34269

SEQ ID NO: 115363 - DNA, 201 bp, Bos taurus; identical to SEQ ID NO: 34270

SEQ ID NO: 115364 - DNA, 201 bp, Bos taurus; identical to SEQ ID NO: 34271

SEQ ID NO: 115365 - DNA, 201 bp, Bos taurus
cgtgtagaagtaaattttaggagaatttggccatatagttctaaatggcaattctaaattccttggttgatacattgagattattcttgaatgactacatrctggtccatgaaacagtgaagcccaaaatgagttaaatgcaagaaataaaatatcttgcgttttacttgtgttctgctgcttgttttgattttggaacta

SEQ ID NO: 115366 - DNA, 201 bp, Bos taurus; identical to SEQ ID NO: 34273

SEQ ID NO: 115367 - DNA, 201 bp, Bos taurus; identical to SEQ ID NO: 34275

SEQ ID NO: 115368 - DNA, 201 bp, Bos taurus; identical to SEQ ID NO: 34276

SEQ ID NO: 115369 - DNA, 201 bp, Bos taurus; identical to SEQ ID NO: 73926

SEQ ID NO: 115370 - DNA, 201 bp, Bos taurus; identical to SEQ ID NO: 73927

SEQ ID NO: 115371 - DNA, 201 bp, Bos taurus; identical to SEQ ID NO: 34278

SEQ ID NO: 115372 - DNA, 201 bp, Bos taurus
gcaccatctcccagtccccatttttaaaaatcctatttctagtatgttcctcacaacagagttggcagacaaggtcaagatcagatctaacctgacttctrgagagcacctataaggagcaggggacatgaacctttgccagatagaaatcactaacccaaggggaaaactctccccctaaaatggcctcacagttgggtt

SEQ ID NO: 115373 - DNA, 201 bp, Bos taurus; identical to SEQ ID NO: 73994

SEQ ID NO: 115374 - DNA, 201 bp, Bos taurus; identical to SEQ ID NO: 73999

SEQ ID NO: 115375 - DNA, 201 bp, Bos taurus
gattctccaatgtgtatctctagccaaataattctcctgcactccaaatatctacttaagctctccacttggatgtctaaaagatgtctcaaaattaacaygtttaaactgaaattctgatcttcccaacccaaacctaatctatctgttgctcattcttctgagaaaactcctctcatgctttaggcagggtgaggagaa

SEQ ID NO: 115376 - DNA, 201 bp, Bos taurus; identical to SEQ ID NO: 34360

SEQ ID NO: 115377 - DNA, 201 bp, Bos taurus; identical to SEQ ID NO: 34362

SEQ ID NO: 115378 - DNA, 201 bp, Bos taurus
atggcttttactctggtcagtgaccattgatgttcatgtgtacgagctcttcaatggtacataaccactactgtggtgggcctacttcacctactaagagygttttggcactctgggactgtgattatgtgtttgttacataacctgtcaatatcagtcttttagaacaaagagaacaggcccctttcctagctccaaggt

SEQ ID NO: 115379 - DNA, 201 bp, Bos taurus; identical to SEQ ID NO: 74004

SEQ ID NO: 115380 - DNA, 201 bp, Bos taurus; identical to SEQ ID NO: 34364

SEQ ID NO: 115381 - DNA, 201 bp, Bos taurus; identical to SEQ ID NO: 34365

SEQ ID NO: 115382 - DNA, 201 bp, Bos taurus; identical to SEQ ID NO: 34367

SEQ ID NO: 115383 - DNA, 201 bp, Bos taurus; identical to SEQ ID NO: 34368

SEQ ID NO: 115384 - DNA, 201 bp, Bos taurus; identical to SEQ ID NO: 34369

SEQ ID NO: 115385 - DNA, 201 bp, Bos taurus; identical to SEQ ID NO: 34370

SEQ ID NO: 115386 - DNA, 201 bp, Bos taurus
cttgtttcatttcagcagcaactctgcaggatacatatagtttccacattttctgcagaagactggggaaggttaagaaaacgtctgagacaacagggctrtagcagaaccaggacctaaatttagttctttgtgtgtgtagatcccattccttctactattctattctggttaaatggatctttttaaaattttggtctc

SEQ ID NO: 115387 - DNA, 201 bp, Bos taurus
ttggtggccactctgtagttggtaatcattaaaaggtgtatgtgacagataaaaaataaaaagaactgaccctactttccttggtaactccatcacttgckccagtttcaagattccactaaggcctcctgtgaggtgggaggaagatgttgagaatatccatgaagtttacttcctggaaaccatgactggagggagcaa

SEQ ID NO: 115388 - DNA, 201 bp, Bos taurus; identical to SEQ ID NO: 34372

SEQ ID NO: 115389 - DNA, 201 bp, Bos taurus; identical to SEQ ID NO: 74011

SEQ ID NO: 115390 - DNA, 201 bp, Bos taurus; identical to SEQ ID NO: 74012

SEQ ID NO: 115391 - DNA, 201 bp, Bos taurus; identical to SEQ ID NO: 74013

SEQ ID NO: 115392 - DNA, 201 bp, Bos taurus; identical to SEQ ID NO: 34373

SEQ ID NO: 115393 - DNA, 201 bp, Bos taurus; identical to SEQ ID NO: 34374

SEQ ID NO: 115394 - DNA, 201 bp, Bos taurus
gctagggccagggtgatcacagggaaagaacaagtggtgtcagaaagtaagaaagtgctcagtaaacatggggtcattaaaacaagatgcacaagtcaaaytgaaacactggccaaatctgggataatctgagaacaaaataataaatggtaatgttttaggtcaggcagctgtaacaaaatacgatagactaagtggctt

SEQ ID NO: 115395 - DNA, 201 bp, Bos taurus; identical to SEQ ID NO: 34376

SEQ ID NO: 115396 - DNA, 201 bp, Bos taurus
catctattttatgtctttacaggcttgccagttctgtacatttcatattaaaggaaacatacaatgtgttctttttgtgactgatttctttttctcagcakgttttcaaggccaattcatgttgcagcatgtatcgattcttccctcctgttcactgctgctgctgccgctaagttgcttcaattgtgtcagattctgtgc

SEQ ID NO: 115397 - DNA, 201 bp, Bos taurus
ctgctaccagaacatcaatgggtcctgtgttaagacctcttacacaccaggtcctcgggcaattctatatgcagtcctcggtttgggggctgtgctggccrtgtttggaaacttactggtcattattgttattcttcacttcaaacagctgcacactcccactaactttctgatcgcatctctggcctgtgcagacttctt

SEQ ID NO: 115398 - DNA, 201 bp, Bos taurus; identical to SEQ ID NO: 34380

SEQ ID NO: 115399 - DNA, 201 bp, Bos taurus; identical to SEQ ID NO: 34381

SEQ ID NO: 115400 - DNA, 201 bp, Bos taurus; identical to SEQ ID NO: 34382

SEQ ID NO: 115401 - DNA, 201 bp, Bos taurus; identical to SEQ ID NO: 34385

SEQ ID NO: 115402 - DNA, 201 bp, Bos taurus
gaaattacttttacatcagttatgagaacagcagggggtggaggtaggggagacactaaaaagggctctgaaaaatgaatggtctaacacatcattttttwaaattgcatttagtattttacaaatgacaagtacattctccaaattttgaggacccactgcttttctagaggaaatctactaccacctattattattgct

SEQ ID NO: 115403 - DNA, 201 bp, Bos taurus
tcacggcgggggtgtgggggcggggggagtgcgggggagaaacgcccggttttctttttaccctagttcttgtatttccgggccaggagctgatggtttgyaaggcattgctgctgctgctgctaagtcacttcagtcgtgtccgactctgtgagaccccatagagagcagcccaccaggcccctcggtccctgggattct

SEQ ID NO: 115404 - DNA, 201 bp, Bos taurus
ttactgctcgtggacattctctagttgctgcgagcggggtctactctttgttgctgtgccaggcttttcattgaggtgacttctcttgttctggagcacargctctaggctcatgggcctcattacttgtgacgggtgggctctagaattcaggctcagtagttgtggcttatgggcttagctgcttcaccgcaggtggga

SEQ ID NO: 115405 - DNA, 201 bp, Bos taurus
actgagctatgagggaaaccttgctttccttttattatgtcttgtgtggatcaacatcttttttcaacatactgtattcttttgaatacaaaagcttacartattccaatctgttaggtatgtctttaatgtgatccttttgaactgtagtttctcatcaacctctttcttatcaatcctacctgccttctgtttttcaga

SEQ ID NO: 115406 - DNA, 201 bp, Bos taurus
gaaaagcagagtgaaattaggtagtgagtctaattgaaatcaggtcacaaatctcaaacaaataaaaggcctattccttttagagatttctgatttgtagraagaacactgacttttactgcaatagtaagctagtttttttccttcactaggtaaaatgaaggaaagcagacagaccaggggtagggtggagaaggacgg

SEQ ID NO: 115407 - DNA, 201 bp, Bos taurus; identical to SEQ ID NO: 34391

SEQ ID NO: 115408 - DNA, 201 bp, Bos taurus; identical to SEQ ID NO: 34392

SEQ ID NO: 115409 - DNA, 201 bp, Bos taurus; identical to SEQ ID NO: 34393

SEQ ID NO: 115410 - DNA, 201 bp, Bos taurus
gccttttcctgtagcccaggcagcatgaattcccatcacccctactcccctactccttttcattgtcaccagcagcctgcatgtagccgaatccagaggtyactgcctaagcctcgttttactttgcttactggcagtcttcaacagaattgacacccccacgctcttgaaccacctgcctctcctcactctagggtacca

SEQ ID NO: 115411 - DNA, 201 bp, Bos taurus; identical to SEQ ID NO: 34396

SEQ ID NO: 115412 - DNA, 201 bp, Bos taurus
tacaaacttccagttatgagattaataagtcacagtgttctatcgtttagcatagtgagtatggttaataaagctactatatatacttgaaatttcctaaracaggagatcttgtattcttaccacaaaacaaaaatggtaactttgtcaggtgatggatgtgctaattaatgtcactgtagtaaccatttcacacagact

SEQ ID NO: 115413 - DNA, 201 bp, Bos taurus; identical to SEQ ID NO: 34403

SEQ ID NO: 115414 - DNA, 201 bp, Bos taurus; identical to SEQ ID NO: 34404

SEQ ID NO: 115415 - DNA, 201 bp, Bos taurus
atttctgcactgaaggattcccagaaaacagatgcattatataagatggtagagcttgaggatgcattaattcaataaagcacagctggaacatgaaacaragccttttcccattcatctgattagcttttggtccttataggaagtgacataccaaggtttatgaatccccctgatacatacttcagcactgggctcttt

SEQ ID NO: 115416 - DNA, 201 bp, Bos taurus; identical to SEQ ID NO: 34405

SEQ ID NO: 115417 - DNA, 201 bp, Bos taurus; identical to SEQ ID NO: 34406

SEQ ID NO: 115418 - DNA, 201 bp, Bos taurus
aaaaaatatccagtgactagtaagtcttgattactaatccagagtcttttctcttgctttccagtggcaaccactattatcagtttcctggtgtttctttycaaagatattctatgaattgaataacaggacatgtatacacatatacacattttgaaaacacaaacggtggcatattaaacactgtttttcactttgctt

SEQ ID NO: 115419 - DNA, 201 bp, Bos taurus; identical to SEQ ID NO: 34409

SEQ ID NO: 115420 - DNA, 201 bp, Bos taurus
gcccagcaggaaaatgggggagagctgaaagggtagaaaagggctaatccccctttgcctgtcactggcccctctgtgtcacatattgggcattgactcaycctagccagcacaagatttagaacctggtatttttgtcttatgtgtgttggatgagctgatttttattcacagtttcaatcaagaaaggaactgatatta

SEQ ID NO: 115421 - DNA, 201 bp, Bos taurus
aggcaaaaggaaaatccaacatattgcattaagtggatgacagaatttacatctgcttgggtaccatttagggagatttagtgtggccttaaaaagcaaaygactatttttaagcactttttaattggatatatgagcttattatatggtaagatgtatgaaactggataaagaactcatttataattatgcctcatccaa

SEQ ID NO: 115422 - DNA, 201 bp, Bos taurus
atcctatttcctgactgacatcctctcactgatccagagaatgtgaagaatggggtagagagtgaaagaggaggggccttcagggagagtaaaattgtccrgggatagttcttgtcctgtctctaagaccctccctgctcaatgtgttttctgctgagagtgaattacaggaaatgaagcagatgatccaagtggcccttg

SEQ ID NO: 115423 - DNA, 201 bp, Bos taurus; identical to SEQ ID NO: 34419

SEQ ID NO: 115424 - DNA, 201 bp, Bos taurus; identical to SEQ ID NO: 34420

SEQ ID NO: 115425 - DNA, 201 bp, Bos taurus
tcgcaaagagtaggacatgacagcgcgtgaacaacaacaaaggaagagagacaaaatgcatagggttgtgcatggtctccaccgactgactttgggaatcrtggaaagttaaactgaataaggaagtggggggtttcagatggtagtgaaccatgaggtttagtcaaagaacttcgaacgtggtatcaaagagccaaggta

SEQ ID NO: 115426 - DNA, 201 bp, Bos taurus; identical to SEQ ID NO: 34421

SEQ ID NO: 115427 - DNA, 201 bp, Bos taurus; identical to SEQ ID NO: 34422

SEQ ID NO: 115428 - DNA, 201 bp, Bos taurus
ttcttaattgtatgttctgatttatccgaagtggatagaaaaacaaattatttctgctaaattatacttaggaggatagtacttgaaagcattctaaaagktagaaacaagaaagatattaagaggaagtttaaagaaaagtgaagaacttaaaaaggaagtgttaaatgttaatcatatcactgtttagaataataagaa

SEQ ID NO: 115429 - DNA, 201 bp, Bos taurus; identical to SEQ ID NO: 34423

SEQ ID NO: 115430 - DNA, 201 bp, Bos taurus
ctactcttgctgttccccacagttcagtcctaggccctcttctttgcctctttcagtatgtggagagagagcttcatttcacagattcaaaaactgtctgytcatgactccacaatccatttttacctatgcatgcctcttcatctgtattatgtaattgcacctccgtcagcttattgaatccttctccttaaactcttc

SEQ ID NO: 115431 - DNA, 201 bp, Bos taurus
gctgtatttcattactggatactaactcttgaaattgtcttgattatattattgtattgtggctttgatgagacgattttttgagggctcttcttaacccrtgaatatgaattaaaagggaaaaagggaggatacaaagggaagacctgagtgacttaaatttatactcagcttgatccacttgctgaactgattattatt

SEQ ID NO: 115432 - DNA, 201 bp, Bos taurus
gaatgaaactgtaaaagaccacaataagatctaaaaaaaagaaaagtatgattggaatccatgaaagagaaataatagataatgtggcaggtacaatattrgaagacataataactcataactattcatcaagctgctgatttgagaatctctatgagtctcataaaaaataaatacaaaggaaattacacttaagtacac

SEQ ID NO: 115433 - DNA, 201 bp, Bos taurus; identical to SEQ ID NO: 34426

SEQ ID NO: 115434 - DNA, 201 bp, Bos taurus
taacataacatattatgtgttaaagacacaaaatatacacataaacatatttcatattcctactaaaattgaggcaagagaccttcttttctacatttgtrttagtttccagttccatatcctggattttatatatatatatatatattttttttttctttcatgaattcatcatccctgcttggtttcatgaggaaatcc

SEQ ID NO: 115435 - DNA, 201 bp, Bos taurus
caatacagctaccagaatagtaatatcttgctatatatttttttaaagtaatacatctatttctgcaagtagaagttatcactgtttgattagcccacttycagttagcattttcatttgaatttcgcagaaacttgcttgttcaaaaactttggtagataactatgcacagactgtcttctaaatactcagaattgtcaa

SEQ ID NO: 115436 - DNA, 201 bp, Bos taurus
ttaatctatagcaaattctaagtaacttttaggttttattacactctctagttctctactattttccttaactcatttctctcctggtgaggcctttttcrtcttggacttgctctgtccagcctgcattttgttctggtctgccagtgcattcattctccaaatgggaacaggcccatctctttccatcccccaccccac

SEQ ID NO: 115437 - DNA, 201 bp, Bos taurus
agttaaggccaaaatatgagtggggagaatagataagtagtctctaaatgagattaggtttaacatttaagagtaagaaaagatctaaggatgtcccagaktctaggaggacaggccagttggcatcttccaagatcatagtccaaagagaatagaccaggattgacaggaaggatggactagatagaaggagttcgtcca

SEQ ID NO: 115438 - DNA, 201 bp, Bos taurus
cctaatacctttggcccaattgggtctgccttcttgggctccacatcaagagggtgacgcaagctgggtcacacatctctgagcaatttcagaataaactrttgtaatcaacatagtccctggaccccagaccttctgtcatcaatcagatacagattaaactggcaggatgctcacgtgtcagaagaaaaaattaacaca

SEQ ID NO: 115439 - DNA, 201 bp, Bos taurus; identical to SEQ ID NO: 34427

SEQ ID NO: 115440 - DNA, 201 bp, Bos taurus; identical to SEQ ID NO: 34433

SEQ ID NO: 115441 - DNA, 201 bp, Bos taurus; identical to SEQ ID NO: 34434

SEQ ID NO: 115442 - DNA, 201 bp, Bos taurus; identical to SEQ ID NO: 34435

SEQ ID NO: 115443 - DNA, 201 bp, Bos taurus
ttgtttgaggctgcagctggtgaatggacctctgaatgggggtgagggggatgaaaaagaattcacacagggatgtgttgctttctctcctgagttattartaatagtttagcaaaatcatcatgtttcggagatttggtttcatttgcaaactttgtaatatccttacctacactcaccatgtttcctgtcttttttatg

SEQ ID NO: 115444 - DNA, 201 bp, Bos taurus
aatgaacagtgaagagtagacttaactttgctctgacaaaaacatgtaaaccactggcacttcattctgaagccatgtacttcagttactgtgattgaggkgtttctgtcagtgtcatttggcaggatgttattaaggagaaatatccaacatggtgaagtgtatttgggaacaaaacaagtgagtagctaaattaaaagt

SEQ ID NO: 115445 - DNA, 201 bp, Bos taurus
agttacacactgagtttactattgacttattttcatgaatatgtgtatggtagccaactaattattttagggggctgcaaacattcacatggttccttaartttcaatttatgtctattcaccagtacccataaagcaaacagtacagtgcatttcatattcctgaacggcttcctgacatgttttagctatattatgtaa

SEQ ID NO: 115446 - DNA, 201 bp, Bos taurus
ttgtagatgagcgtttgggttgtttccacccttcggctattgtgactaatacttctggtttcttttgctgctggctggtctcagctctttgtgcttcataygagctggcttcctctccgctctagtgttgcttgtctgtaaatgtgacatcagtggctgaagtacccatccctccagctggctggggcagccattatttct

SEQ ID NO: 115447 - DNA, 201 bp, Bos taurus
aattatggaccttgggtagaaacagcccaaatttctaaattaaagtaaggatgcctttcttctgaagagtccaactttattaccttgattatttctatatkcctttaaagtgttttaaattatgaagtattacaaacttcttgaagagtacagatgatattactaacacctataaatacatccctcagatatagctaatgt

SEQ ID NO: 115448 - DNA, 201 bp, Bos taurus
aaatgaagacagtttggattggaattccaaagccgcctgttttctgtttgtcacaataatgttttgcttgtgaattaatttcatttagactacattttatyttttgctttgaaaagataataaccagaaagagtttaaagcacttcatttctattaagtaataaaccatttgtgatatacctagaaatatgtacttgaaca

SEQ ID NO: 115449 - DNA, 201 bp, Bos taurus; identical to SEQ ID NO: 34449

SEQ ID NO: 115450 - DNA, 201 bp, Bos taurus
tgtcttttgagaatgagccgtgcttctgttttcctcatagagcgagaaagaaatcctggttaattaagcagtggttctccttaattttactgggccacagrggaagcctaagaatacaggagtggatagcttatcccttctccagcagatcttcttgacccaggaatcgaaccgggattgcctgcattgcaggccaattct

SEQ ID NO: 115451 - DNA, 201 bp, Bos taurus
aaggcaggatgctgtggtcagaagtgacaggcagagaagccggaggaaatgtcactgctgtgtggaataagatggggcctatgcagtgcactgcaaaggarggacagttttattcctttcttcctaagccactcccacttctagaccttacctcttgcatagacatccccactggaaggaagagttgctattccaggcccc

SEQ ID NO: 115452 - DNA, 201 bp, Bos taurus
ggccacagtctctgttgttctggttcagccttatttttaggcagcactttgttcctgcatctcaaggtagggaccatctcagtgactcttgtcctctttcraatggtctgggcccagtgtctgtttctgctcctactcccataattagagaatattatttgttcacttctcctaactacatggattgttccctgtgcctta

SEQ ID NO: 115453 - DNA, 201 bp, Bos taurus; identical to SEQ ID NO: 34450

SEQ ID NO: 115454 - DNA, 201 bp, Bos taurus; identical to SEQ ID NO: 34453

SEQ ID NO: 115455 - DNA, 201 bp, Bos taurus
gaatgagatccctgatggtgaacaagatggacctaggttagtagcaaccagagaacccaggtaaactgaactcagtcttctctgtgtacctgctcagtcaytaagtcgtgtccgactctttgcaaccctgtggactgtatctcaccaggctcctccatccatgggatttcccaggcaagaatactgaagtgggttgccact

SEQ ID NO: 115456 - DNA, 201 bp, Bos taurus
attaactgtaaagctcctagtgtttttctttttttaagggaaactgctgtaccctctttcattttcttgtatttctaagacctggaatgagattcttatcyaccatgctcatgaatgttgacggtgataatgatctcctggacattacttgtacttttttctcataggaaagaaaataaatcttcccccaaaaatatattt

SEQ ID NO: 115457 - DNA, 201 bp, Bos taurus; identical to SEQ ID NO: 34454

SEQ ID NO: 115458 - DNA, 201 bp, Bos taurus; identical to SEQ ID NO: 34462

SEQ ID NO: 115459 - DNA, 201 bp, Bos taurus; identical to SEQ ID NO: 34464

SEQ ID NO: 115460 - DNA, 201 bp, Bos taurus; identical to SEQ ID NO: 34465

SEQ ID NO: 115461 - DNA, 201 bp, Bos taurus
agctggtgactcatgaagacataagttggaggagaaaacagaattgtaggtggtttcatgggtatttgagtaaaatatttagttctcaaaaattacctatktatattgataggaattatcagtgtacctgggatgagttgtaatatgtgttgggatttcaggtggctgaataaataacactcctttagtcctcttctgaat

SEQ ID NO: 115462 - DNA, 201 bp, Bos taurus
aaaaagaatcaagcacaccaactagtagatcccttcatctgtctccagaaaggacgtttttacctgtattcatgttttgaatctgtgataaatgccagggytgtaattaagaaaagacttaaggcaaagcagaggaagggccattgtgttcaaaatgtttagaaacgaacgtggacaaagacaactgatttttcctttggg

SEQ ID NO: 115463 - DNA, 201 bp, Bos taurus
cttactgagtgctgtctttacccacttaaacatagcctgaaagttcgattttcagaatgagggtgttctgtgagtttatcctgtgtagacaaggccaggcwcatcttctgaaaatggcgctgtcccccttttctcttttccctccacagtgagtggtctctctctgagccctatgagcccacacacctggccggcccatca

SEQ ID NO: 115464 - DNA, 201 bp, Bos taurus; identical to SEQ ID NO: 74043

SEQ ID NO: 115465 - DNA, 201 bp, Bos taurus
ttagaaagctgctgggtttagtgtgatgatgcaaaggcacaaggtcagacagacaagtcaatggaacagaaacagatgctggtgtaaaaagtgctgtggtrtaatttagagaccattacaaagaaagagtaaataaaggtgtcatatagttggctaaattttcagagaaaaaaatggaatctcatgttatattatagggct

SEQ ID NO: 115466 - DNA, 201 bp, Bos taurus; identical to SEQ ID NO: 34468

SEQ ID NO: 115467 - DNA, 201 bp, Bos taurus
atgcagtgaccaggttagatgtaaaacacgtcagggatctataggagggagtgtccgaccctgtgagggaaggaaagatatgagagggagttcttcctagraaaagtgacacaatctgtgtgccagataggcaaagaagaggagaatttgggagaagcaaggccatttcagtcagaacaacatgtgtaaaggatggaggta

SEQ ID NO: 115468 - DNA, 201 bp, Bos taurus; identical to SEQ ID NO: 34469

SEQ ID NO: 115469 - DNA, 201 bp, Bos taurus
aggatgggaggacaccatgaagatatcatcaaataatttcagaatgtggaatattctacaaagcaactggcctgaactcttcaatctcattttaaaaaaawgtggttggggtggaaggatagcaggaaactcttttagaccaagagaataaaatgacaataacaagccctacatgaagcatggttgagcctgggtttaaaa

SEQ ID NO: 115470 - DNA, 201 bp, Bos taurus
actgtgggaagcattggacttgcagctgaatgagtgagtctgcaggattggaagagggaccctacctagggactcttgcattaaaccaagattttatttcraatagtgtgacctaccaacttttaaaaatctctcttttctttcttgtttaacattataatttcattttcctgctagatctgaaccattgcaaaaaaaaaa

SEQ ID NO: 115471 - DNA, 201 bp, Bos taurus
ggggccatcctgcttttagcatcgctctgttattccttgttttactgcagagcagtggtaattgatgttgatgatctattaaacagatggcgggatgagcmggaagcatcttagttaaaagacagttcaattctatcattcttgttgaaacactttaacctctgatttaattttattccactgggattgagggttatggtt

SEQ ID NO: 115472 - DNA, 201 bp, Bos taurus; identical to SEQ ID NO: 34475

SEQ ID NO: 115473 - DNA, 201 bp, Bos taurus; identical to SEQ ID NO: 34476

SEQ ID NO: 115474 - DNA, 201 bp, Bos taurus; identical to SEQ ID NO: 34477

SEQ ID NO: 115475 - DNA, 201 bp, Bos taurus
ctggagctgcccgagaaaattaagaatggtgatgctgatgttgagtggagaataaagctgccaactggtgagagagcccttgtgaggccaagcagcagagygctcaccagggtttataagtgcaaaggatttccttccattctctgaggacgtttgacagacgaatgattgcagcttattgatgggcatatcagcaagcat

SEQ ID NO: 115476 - DNA, 201 bp, Bos taurus; identical to SEQ ID NO: 34478

SEQ ID NO: 115477 - DNA, 201 bp, Bos taurus; identical to SEQ ID NO: 74051

SEQ ID NO: 115478 - DNA, 201 bp, Bos taurus; identical to SEQ ID NO: 34480

SEQ ID NO: 115479 - DNA, 201 bp, Bos taurus; identical to SEQ ID NO: 34482

SEQ ID NO: 115480 - DNA, 201 bp, Bos taurus; identical to SEQ ID NO: 34483

SEQ ID NO: 115481 - DNA, 201 bp, Bos taurus; identical to SEQ ID NO: 34484

SEQ ID NO: 115482 - DNA, 201 bp, Bos taurus; identical to SEQ ID NO: 74057

SEQ ID NO: 115483 - DNA, 201 bp, Bos taurus
ctctaaaatgagcaactttaaaaagaaaataaaaataaggtgggttgctggagaaatgggtatttattttttcaatatgttttaccaaacatatatgatcraaattctgttgtctgaatcaaatattaggctgaaaatgaagtcaggaaacagagaataacctaacagcccagaatgagcacccctttacatccatcacca

SEQ ID NO: 115484 - DNA, 201 bp, Bos taurus
atcattgtctgtagctaagacttaaatatggcccctatggtgtgctacatgccatttaagtactttacataaaaactcatttacctttaactgagaacttyatgacaattgcttcaatattggtgtgggttaaattcggagagactgttattcgatgtaatacacgtcttctggggaatataccctgtattgcactcatct

SEQ ID NO: 115485 - DNA, 201 bp, Bos taurus; identical to SEQ ID NO: 34486

SEQ ID NO: 115486 - DNA, 201 bp, Bos taurus; identical to SEQ ID NO: 74060

SEQ ID NO: 115487 - DNA, 201 bp, Bos taurus; identical to SEQ ID NO: 34490

SEQ ID NO: 115488 - DNA, 201 bp, Bos taurus; identical to SEQ ID NO: 74062

SEQ ID NO: 115489 - DNA, 201 bp, Bos taurus; identical to SEQ ID NO: 34493

SEQ ID NO: 115490 - DNA, 201 bp, Bos taurus; identical to SEQ ID NO: 34494

SEQ ID NO: 115491 - DNA, 201 bp, Bos taurus; identical to SEQ ID NO: 74067

SEQ ID NO: 115492 - DNA, 201 bp, Bos taurus; identical to SEQ ID NO: 34500

SEQ ID NO: 115493 - DNA, 201 bp, Bos taurus; identical to SEQ ID NO: 34501

SEQ ID NO: 115494 - DNA, 201 bp, Bos taurus
cactagaggatgaccctcttcccagtatatctaactttttatttttttcttgagaatctcaggtttcttatgcatacagaatccctatatcacccacatgyttgcacattaacttgcacacacacaccacatcacatgcatgggcacatacatgtataggcacatatacacactcctgatagacattctaagaacttttca

SEQ ID NO: 115495 - DNA, 201 bp, Bos taurus; identical to SEQ ID NO: 34507

SEQ ID NO: 115496 - DNA, 201 bp, Bos taurus
caggcgccaagtcttccgagttccctaagggacagggtggaaaacaaagctgaaagtttgcttgatgccgtatcacagaaggccttacataacaggataargaggagggttttgtgtagttatttttgtgctcacaatctataaaatactgcaaatataccatgagaatttattttatggaaaagaggatcaagaagatgg

SEQ ID NO: 115497 - DNA, 201 bp, Bos taurus
ctaccaaacccacagatagtggccattcattataaaaatggactgaaggtgttggtggtgataatcaggatggtactgaagaggctggggctctaacaggrggagagaaaaggcctcagaaggaagccgaccacttgcagagaatgctgtgggtgacccagccacgcggccacgtcctgatcacccggggcacgctggcca

SEQ ID NO: 115498 - DNA, 201 bp, Bos taurus
tttttctgatatttagttttcattatttattcttcatcgcttcaactcttagctctttaggaaagactgtgttttttgcttttctctgaattcttagggartttagtcccatatcttctgagtactgtgtgtacataaaatgatactgttatcccccaatctaaacttctctttcttctaaaacttacttttagatctcct

SEQ ID NO: 115499 - DNA, 201 bp, Bos taurus
tctctccacatcctaaggccctgagcttgtacactgagctggaggctgaactgaagtaaggtttctcctctaggggatgagttaaaaataattcactgtgytcaggcccagcagtctttagggagagacatctgtactgactgcagattcaaacatcacagaggaagtgacccttccatcatcagggattgactggtttcc

SEQ ID NO: 115500 - DNA, 201 bp, Bos taurus
ggacagggaggcctggcgtgctgccattcatggggtcgcaaagagtcggacacgactgagcggctgatctgatctgattcgctgatcttaagagaatagtyccaaggaggcccaataaaatcacgtgaatctttaaaagtagaaaaaggagggagaagagagagtaagccagagagagattaagcagaggaggaatgcaga

SEQ ID NO: 115501 - DNA, 201 bp, Bos taurus
agtgggaaaacgagccatatagaacagcagggattgcctatacacttttgctatctgacaaactaaattttaagaccgtagaggcaatagacatactgctrttctctctggacagtttttatttgggagacttgtcaagtcaatgaacatattggataaatcaagtgaaaaatgaatcacccaaaaagtacccaactcttt

SEQ ID NO: 115502 - DNA, 201 bp, Bos taurus
tgagggttccatgtacctcctaaaatagtgtgcaaacctttatacttgcagtttctagggtgtggtctagacatatttttaatctaacattctatgcaccrttgccgcaggaacatcctgacaatatcaggatgcatcaatatttattctaacatcacatctggtacatttggatcagctgaggtttgaagcaatgtttta

SEQ ID NO: 115503 - DNA, 201 bp, Bos taurus; identical to SEQ ID NO: 34511

SEQ ID NO: 115504 - DNA, 201 bp, Bos taurus; identical to SEQ ID NO: 34512

SEQ ID NO: 115505 - DNA, 201 bp, Bos taurus; identical to SEQ ID NO: 34513

SEQ ID NO: 115506 - DNA, 201 bp, Bos taurus; identical to SEQ ID NO: 34514

SEQ ID NO: 115507 - DNA, 201 bp, Bos taurus
aagcgtgcaagtgtcaggccacctccatatgtcaaaagctggagacatgagggattgagccaaccttgcagtttcagaaaagcaagaccctaatgaagcarcaggaccaggacaggcccttgtctgattctgggaaccatgactccagagaaatcccacccctcagcccccagacactcacccagatctgcgagtcacttc

SEQ ID NO: 115508 - DNA, 201 bp, Bos taurus; identical to SEQ ID NO: 34520

SEQ ID NO: 115509 - DNA, 201 bp, Bos taurus; identical to SEQ ID NO: 34521

SEQ ID NO: 115510 - DNA, 201 bp, Bos taurus; identical to SEQ ID NO: 34522

SEQ ID NO: 115511 - DNA, 201 bp, Bos taurus; identical to SEQ ID NO: 74087

SEQ ID NO: 115512 - DNA, 201 bp, Bos taurus; identical to SEQ ID NO: 34524

SEQ ID NO: 115513 - DNA, 201 bp, Bos taurus; identical to SEQ ID NO: 34525

SEQ ID NO: 115514 - DNA, 201 bp, Bos taurus; identical to SEQ ID NO: 34526

SEQ ID NO: 115515 - DNA, 201 bp, Bos taurus; identical to SEQ ID NO: 34528

SEQ ID NO: 115516 - DNA, 201 bp, Bos taurus; identical to SEQ ID NO: 74091

SEQ ID NO: 115517 - DNA, 201 bp, Bos taurus; identical to SEQ ID NO: 34529

SEQ ID NO: 115518 - DNA, 201 bp, Bos taurus
tgtaaaggcaggtgaggcaggaatgcaccgggcattttcagaactccccacgaagaagaggaagtggcttccttccgcttggttcagtataaccacctccygtcatccctctgcccaatgctaatggcagccagccgagccggaggtgctgctgctgttgctcagtcgctcagctgtgtccaactccctgcaactccatgg

SEQ ID NO: 115519 - DNA, 201 bp, Bos taurus
gagcgactgaactgaactgagccttataagatggttgagaaaatttttttctagtaagataatgtctccagcccataatagatactcattaaaggcctctktggaattctttttttttttttttccaagattttcttttttatgtagactgtttttaaagtttttattgaatctgttacaacactgctttgatttttaggc

SEQ ID NO: 115520 - DNA, 201 bp, Bos taurus; identical to SEQ ID NO: 34534

SEQ ID NO: 115521 - DNA, 201 bp, Bos taurus; identical to SEQ ID NO: 34535

SEQ ID NO: 115522 - DNA, 201 bp, Bos taurus; identical to SEQ ID NO: 34536

SEQ ID NO: 115523 - DNA, 201 bp, Bos taurus
agggacccctgggtgcccgatcaggaaaggacgccaggaggcacagagcccgagatgctgggtggcttcacggggcggtggcctgtgcagtcccgtgactyctcgccctgtgtttttcccgtctgtggtggcgtcttgggagttctctggactggcgtcagaagtgcgggccagcagtgccagcttgaaagctctgggtgc

SEQ ID NO: 115524 - DNA, 201 bp, Bos taurus
ttacagttagggtgtgtcaacgccgagggtggtggttcccagtgccgccagcagggggcagcagaaagccgtgtgtgtgggcccagcctcccggggctcargaagggtatttaggaatgtgatggggagaccaagctgaggtttaggagggaggtacaggcctggggtagaaaggcaattagcgaggggagtgagtggaga

SEQ ID NO: 115525 - DNA, 201 bp, Bos taurus; identical to SEQ ID NO: 34539

SEQ ID NO: 115526 - DNA, 201 bp, Bos taurus; identical to SEQ ID NO: 34541

SEQ ID NO: 115527 - DNA, 201 bp, Bos taurus; identical to SEQ ID NO: 34542

SEQ ID NO: 115528 - DNA, 201 bp, Bos taurus; identical to SEQ ID NO: 34543

SEQ ID NO: 115529 - DNA, 201 bp, Bos taurus; identical to SEQ ID NO: 34544

SEQ ID NO: 115530 - DNA, 201 bp, Bos taurus; identical to SEQ ID NO: 34545

SEQ ID NO: 115531 - DNA, 201 bp, Bos taurus; identical to SEQ ID NO: 34546

SEQ ID NO: 115532 - DNA, 201 bp, Bos taurus; identical to SEQ ID NO: 34547

SEQ ID NO: 115533 - DNA, 201 bp, Bos taurus
tctgggtagtcatagttgaagtgggtttgctaatcatgaaacccaaggaacacgggaaatagatcatgtctggaaagacgttccgagtgcctttctggccrtgaaacccaccgtagccttttcaaggtcattgtattgtggttgtggtcccgcttcgcacacactggtggttcattcggccaggaattgtgggctctgact

SEQ ID NO: 115534 - DNA, 201 bp, Bos taurus; identical to SEQ ID NO: 34550

SEQ ID NO: 115535 - DNA, 201 bp, Bos taurus; identical to SEQ ID NO: 34551

SEQ ID NO: 115536 - DNA, 201 bp, Bos taurus; identical to SEQ ID NO: 34552

SEQ ID NO: 115537 - DNA, 201 bp, Bos taurus; identical to SEQ ID NO: 34553

SEQ ID NO: 115538 - DNA, 201 bp, Bos taurus; identical to SEQ ID NO: 34554

SEQ ID NO: 115539 - DNA, 201 bp, Bos taurus
agggaaggtgggactcaaagtcaggctgggccgggttaggtttgccctgggggagccttcaaggatttactgttagcttcattcattcagtgcttaaaagrtgaaataccgaggccctcccctgtcagcatcctggggccactgaaaggcaaggcaggtgaggaggaaggctgagtgcctttctccggatccaagcagcac

SEQ ID NO: 115540 - DNA, 201 bp, Bos taurus; identical to SEQ ID NO: 34556

SEQ ID NO: 115541 - DNA, 201 bp, Bos taurus; identical to SEQ ID NO: 34557

SEQ ID NO: 115542 - DNA, 201 bp, Bos taurus; identical to SEQ ID NO: 34558

SEQ ID NO: 115543 - DNA, 201 bp, Bos taurus; identical to SEQ ID NO: 34560

SEQ ID NO: 115544 - DNA, 201 bp, Bos taurus; identical to SEQ ID NO: 34565

SEQ ID NO: 115545 - DNA, 201 bp, Bos taurus; identical to SEQ ID NO: 34567

SEQ ID NO: 115546 - DNA, 201 bp, Bos taurus
aatctcattaaagctcagtttccttatctataaaacaaatgtgtttctctgaagataaaattagataatgcttagcaaaattttcggcccacagtaaactytgattactgttactatttttatgaaaagtaataatcacaaaaatattaagttaatgctgtcgtataggcctcctttttgttcatcactggcattttcact

SEQ ID NO: 115547 - DNA, 201 bp, Bos taurus
ggccactcggccactcgtgaggccgggggtcagtgtgtctggaggagatcacaagccccactcggagaggcggtctcctccctgggccgaggtcagccccyggctggttccactgacagactcctcgtctgggaacctgtgtgtcttttgcttgtgaggacctagctctcacccagacgtgttcggggatttccctgataa

SEQ ID NO: 115548 - DNA, 201 bp, Bos taurus; identical to SEQ ID NO: 34573

SEQ ID NO: 115549 - DNA, 201 bp, Bos taurus; identical to SEQ ID NO: 34574

SEQ ID NO: 115550 - DNA, 201 bp, Bos taurus
ccagcggcaggcaggggcgtctgtgtagggctctgtcgtccaaacagaagtgctgacggcccacccgggcatgcctgggagacaccaggaggtgggttccrgaccgccaccacaagacaactatagcaataaggcaagtgacatgaattttttttttatggtttcccggtgcataaaaaattatgtttacactataccata

SEQ ID NO: 115551 - DNA, 201 bp, Bos taurus
ctattgtcaaggcaacttagacccgagcgtttactgttggccacacatagacaccgtggggatgacttatttggaaaaggcccaggtggcttgctgcattycagtcttcctcctctctcctcctttccctgggttgagggagcatggagtcccactctttaattcaaaagcctttccagtgcggctcacctacctccatgc

SEQ ID NO: 115552 - DNA, 201 bp, Bos taurus; identical to SEQ ID NO: 34575

SEQ ID NO: 115553 - DNA, 201 bp, Bos taurus; identical to SEQ ID NO: 74126

SEQ ID NO: 115554 - DNA, 201 bp, Bos taurus
attagagtccacccaaattactttcttttattgtaattacctgtctaaagacactctccaaataaggtcgtgttctgagtcactgggggtgaggatttcartgtataaattcttaaggcacacaattcagaccacaacaggggccatgtatctaaagagtttatttatttctattgcctttaaaactgatctgtacatccc

SEQ ID NO: 115555 - DNA, 201 bp, Bos taurus
gcctctttcatttccacacacatcaggggctctagctggtctgaaatctgaaaacagaaatgatgtactctctccacttagcagttccctggctggagaarggcgttaacggtagctgggagggagaaacagcggttctaatgcaccatgaccgactcctcacctcccaggggaacattacgacgagcacggcaggagaaa

SEQ ID NO: 115556 - DNA, 201 bp, Bos taurus
aagtgaaggtggtgatttactgcccattaaaaggtgctaataagcagaaaggaaaaagcctctgcccagcgctgccttggcccctcagccccggctctccrgtgtgggtgcgggaagctaatgaaccttttatattgccagtcataaaaagggccaatggctctccatgcagtaatggactctacagtgaaacctgcctaa

SEQ ID NO: 115557 - DNA, 201 bp, Bos taurus; identical to SEQ ID NO: 34579

SEQ ID NO: 115558 - DNA, 201 bp, Bos taurus; identical to SEQ ID NO: 34580

SEQ ID NO: 115559 - DNA, 201 bp, Bos taurus; identical to SEQ ID NO: 34581

SEQ ID NO: 115560 - DNA, 201 bp, Bos taurus; identical to SEQ ID NO: 34582

SEQ ID NO: 115561 - DNA, 201 bp, Bos taurus; identical to SEQ ID NO: 74133

SEQ ID NO: 115562 - DNA, 201 bp, Bos taurus; identical to SEQ ID NO: 34583

SEQ ID NO: 115563 - DNA, 201 bp, Bos taurus; identical to SEQ ID NO: 74134

SEQ ID NO: 115564 - DNA, 201 bp, Bos taurus
aatactttcaaaatctgaaaaatgtttcattatgcaagggataacagtgtaataggagctggacaaccactcccttacacaacttacagtccagcagaggyggtgggcttaaatactttcaaaatctaaaaaatgtttcattatgcaaagggtaacagtgtaataggagctggacaaccactcccttacacaacttacagt

SEQ ID NO: 115565 - DNA, 201 bp, Bos taurus; identical to SEQ ID NO: 34585

SEQ ID NO: 115566 - DNA, 201 bp, Bos taurus
ctcgtggtgggcattcctgcctctctgcttcgtctctgactcgactctcaactcgctgacaagagagatgcggaagacggcccctcggcttccacacctgygtggggctccctgagacacacgtcaggtccttaccacctgccccgactgggcccccacggagacggagcagcaggtgtgtgcgcaggatgcaggaccagc

SEQ ID NO: 115567 - DNA, 201 bp, Bos taurus
cgcctggttcccaagtgctgagccggcggcctgggggagccggcggcctgggggagccggcttcccgcgcctcccgcggcccgccccgggggcgccttacyccctgcgagtgcaggtagtccatggtcttggtgatggtgcacagcactgcgctggcctcccgctccgagaagtaccgctgccgcaggatgcggtccagca

SEQ ID NO: 115568 - DNA, 201 bp, Bos taurus; identical to SEQ ID NO: 34587

SEQ ID NO: 115569 - DNA, 201 bp, Bos taurus; identical to SEQ ID NO: 34589

SEQ ID NO: 115570 - DNA, 201 bp, Bos taurus; identical to SEQ ID NO: 34590

SEQ ID NO: 115571 - DNA, 201 bp, Bos taurus; identical to SEQ ID NO: 34592

SEQ ID NO: 115572 - DNA, 201 bp, Bos taurus; identical to SEQ ID NO: 74143

SEQ ID NO: 115573 - DNA, 201 bp, Bos taurus; identical to SEQ ID NO: 74144

SEQ ID NO: 115574 - DNA, 201 bp, Bos taurus; identical to SEQ ID NO: 34594

SEQ ID NO: 115575 - DNA, 201 bp, Bos taurus; identical to SEQ ID NO: 34595

SEQ ID NO: 115576 - DNA, 201 bp, Bos taurus; identical to SEQ ID NO: 34596

SEQ ID NO: 115577 - DNA, 201 bp, Bos taurus; identical to SEQ ID NO: 74146

SEQ ID NO: 115578 - DNA, 201 bp, Bos taurus; identical to SEQ ID NO: 74147

SEQ ID NO: 115579 - DNA, 201 bp, Bos taurus; identical to SEQ ID NO: 74148

SEQ ID NO: 115580 - DNA, 201 bp, Bos taurus; identical to SEQ ID NO: 34600

SEQ ID NO: 115581 - DNA, 201 bp, Bos taurus; identical to SEQ ID NO: 74154

SEQ ID NO: 115582 - DNA, 201 bp, Bos taurus; identical to SEQ ID NO: 34604

SEQ ID NO: 115583 - DNA, 201 bp, Bos taurus; identical to SEQ ID NO: 74157

SEQ ID NO: 115584 - DNA, 201 bp, Bos taurus
gtgacgtgtattcaacctgtgatgcacgaacagctcaaatcatggttgaatttacaacagaagacgcgagaagaagagtcagaggccaactagacaagtgyctaaagagaagcaaccagagcaaaagatttcaagagataagaaaagggagaggaaaggaggcctggggtaagcgggctgatgttaggagtctcagtgcga

SEQ ID NO: 115585 - DNA, 201 bp, Bos taurus; identical to SEQ ID NO: 34606

SEQ ID NO: 115586 - DNA, 201 bp, Bos taurus; identical to SEQ ID NO: 34607

SEQ ID NO: 115587 - DNA, 201 bp, Bos taurus; identical to SEQ ID NO: 34608

SEQ ID NO: 115588 - DNA, 201 bp, Bos taurus; identical to SEQ ID NO: 34609

SEQ ID NO: 115589 - DNA, 201 bp, Bos taurus
cacttgtcgagttgtatttggaacctgtggctttttccagaggatgcaactggtgtgtcagtgacccttcgtgtgtgatttcatcttaggggttacattcraagtggtgcccaggcatccggccttaccttgagtgaacggggaaattagtgtatttcggaatgcggcatgacccatgaggcttcctctcgagtttcaatg

SEQ ID NO: 115590 - DNA, 201 bp, Bos taurus; identical to SEQ ID NO: 34612

SEQ ID NO: 115591 - DNA, 201 bp, Bos taurus; identical to SEQ ID NO: 34613

SEQ ID NO: 115592 - DNA, 201 bp, Bos taurus; identical to SEQ ID NO: 34614

SEQ ID NO: 115593 - DNA, 201 bp, Bos taurus
accctcgatccaactctcctgaagccagattcagacctcacattcctaattatatgtgtcaacgattttatttctgtgattaatttattttgagattggtrtctgtcatttccaacaaaaatacccttcttttaaaaattttaaacattttcctctcttccattttttatttccttttttattttccttccctttcctttt

SEQ ID NO: 115594 - DNA, 201 bp, Bos taurus
agcagtctcatttcatttgaacataaagatggcacagttttgaactcatttgacatccgaaacactgcaaccagcagccctgctactggcctccgcagttycgctgcagggactctaagagctctagcacaattatcagctttatattaagtatctgaaagtgcatatatttaagtgacaaacttcataaattcaagggaa

SEQ ID NO: 115595 - DNA, 201 bp, Bos taurus; identical to SEQ ID NO: 34619

SEQ ID NO: 115596 - DNA, 201 bp, Bos taurus; identical to SEQ ID NO: 34620

SEQ ID NO: 115597 - DNA, 201 bp, Bos taurus
ggatattaataatttccctatcaggggtctaacccaggcccatggcaatgaaagccctgagtcctaaccactgatttgcctgggaattttcctttcctccyagagttcttgaagtacctaagtctccaaaaggtgtgctatttttccctccacttccttattttattttttatatgatccttttcaattttggtaatatcc

SEQ ID NO: 115598 - DNA, 201 bp, Bos taurus; identical to SEQ ID NO: 34622

SEQ ID NO: 115599 - DNA, 201 bp, Bos taurus; identical to SEQ ID NO: 34623

SEQ ID NO: 115600 - DNA, 201 bp, Bos taurus; identical to SEQ ID NO: 34624

SEQ ID NO: 115601 - DNA, 201 bp, Bos taurus; identical to SEQ ID NO: 34629

SEQ ID NO: 115602 - DNA, 201 bp, Bos taurus; identical to SEQ ID NO: 34630

SEQ ID NO: 115603 - DNA, 201 bp, Bos taurus; identical to SEQ ID NO: 34632

SEQ ID NO: 115604 - DNA, 201 bp, Bos taurus; identical to SEQ ID NO: 74177

SEQ ID NO: 115605 - DNA, 201 bp, Bos taurus; identical to SEQ ID NO: 74180

SEQ ID NO: 115606 - DNA, 201 bp, Bos taurus; identical to SEQ ID NO: 34640

SEQ ID NO: 115607 - DNA, 201 bp, Bos taurus; identical to SEQ ID NO: 34641

SEQ ID NO: 115608 - DNA, 201 bp, Bos taurus
agatttcagtgtttcattttgccttatcagtgaggatgctgtttatgatgcaagggcatcaagacttacgggctagaggaacaccactcatactctcctcytctccctcacttctcagtggtctgagtctgcagcaagctgctgtgcatcttgggtgatcataggaggactgggaagtcccatctgagaaccaaagtgaga

SEQ ID NO: 115609 - DNA, 201 bp, Bos taurus; identical to SEQ ID NO: 74183

SEQ ID NO: 115610 - DNA, 201 bp, Bos taurus; identical to SEQ ID NO: 74185

SEQ ID NO: 115611 - DNA, 201 bp, Bos taurus; identical to SEQ ID NO: 74186

SEQ ID NO: 115612 - DNA, 201 bp, Bos taurus; identical to SEQ ID NO: 74187

SEQ ID NO: 115613 - DNA, 201 bp, Bos taurus
ttctttccatctgggtgcaaaggcggccgacagaacccctgtgtttacggagcaagtgagctggaaatgacttctactttccatttaggaccagcacaccytggcccacaaaacagattttgctgcttgataaaatgaatctgaggggacattatcgctgttttaccaaagcagtcatagctgacgaacatggacaacaac

SEQ ID NO: 115614 - DNA, 201 bp, Bos taurus
ctgttttttgctccaggcctctgtccttcgggctgtggaggacagtagtagcaggtaggaggcttggacaaaagctgcatgtatctcactctggctgaacyccacttctgggccccatctctccacctgccctcttcagttaggagaccagaacccagaacacaagtgttcacaagtgggctctggattccagagttgcag

SEQ ID NO: 115615 - DNA, 201 bp, Bos taurus; identical to SEQ ID NO: 34643

SEQ ID NO: 115616 - DNA, 201 bp, Bos taurus
aagttcatgtgactcactttattgacatacttgctttgttgtgccgtctggagcccagccggagacatctctgaggcctggctgtgtttgaaaagactcaycgtggtcaccgtgtggaatgagtgctgtgtaggttccagggcagtggcaggcgggcgccttaggcactgctgaagattcaagtcaaagatggtggcctta

SEQ ID NO: 115617 - DNA, 201 bp, Bos taurus
attccaccattctccaagatgctctcaaagacctatctcttcctttgttgttgagacagccccagttcctccactgttatttctctcactgaaatacacaygactttatttaactaaggtttgtccctgctagttttgagccagttctgctacgataaaagaagtgtctaaatttcaaattagggcacctttaagtcatgc

SEQ ID NO: 115618 - DNA, 201 bp, Bos taurus; identical to SEQ ID NO: 74189

SEQ ID NO: 115619 - DNA, 201 bp, Bos taurus; identical to SEQ ID NO: 34644

SEQ ID NO: 115620 - DNA, 201 bp, Bos taurus
gtgttcttagcgatgtctgcttatgctcaaagatcattatgcctgcctaaatgtctcccgctgtatgtttaataatttatcccagatttttctaagtaacyacagtaagctgatcatcttaaattcacaaattctactttttccacacacttaaaagaatgtatttaagtgttgttgctgttgttgtttagttagtaagtc

SEQ ID NO: 115621 - DNA, 201 bp, Bos taurus; identical to SEQ ID NO: 34645

SEQ ID NO: 115622 - DNA, 201 bp, Bos taurus; identical to SEQ ID NO: 74200

SEQ ID NO: 115623 - DNA, 201 bp, Bos taurus; identical to SEQ ID NO: 34646

SEQ ID NO: 115624 - DNA, 201 bp, Bos taurus; identical to SEQ ID NO: 34648

SEQ ID NO: 115625 - DNA, 201 bp, Bos taurus
tgggggactggggtggggggtgggggtggggggttggtaacctaaaatcttttctacctgtccctagctaaccccagggcctcaagcccactgttctccckgagtttcctgatattgtttctgccctgcggtatcttgggttcatatcaggcccagaatagaaaggaagataaatgataagggtgtgaataccctcagggg

SEQ ID NO: 115626 - DNA, 201 bp, Bos taurus; identical to SEQ ID NO: 34650

SEQ ID NO: 115627 - DNA, 201 bp, Bos taurus; identical to SEQ ID NO: 74204

SEQ ID NO: 115628 - DNA, 201 bp, Bos taurus
aataagagttcagatcttgctcctaactccttttgcctgccagattgatgtttcaggtgcctcattagtcggatgtgtgcttggcctttcttggggaatgratgagtgaccttcatatcctctcttctgcttgggagtgaagtgaagtaaaagtcgctcagttgtccaactctttgcgcccccatggagtatacagtccat

SEQ ID NO: 115629 - DNA, 201 bp, Bos taurus; identical to SEQ ID NO: 34651

SEQ ID NO: 115630 - DNA, 201 bp, Bos taurus; identical to SEQ ID NO: 34652

SEQ ID NO: 115631 - DNA, 201 bp, Bos taurus; identical to SEQ ID NO: 74206

SEQ ID NO: 115632 - DNA, 201 bp, Bos taurus
tgggcctgtttttccttggaggagtgtggcagaccaaggacactcggcccacacctgaacctgggcagacgctcctgactcagagaccaagcacttcctcyaggtaaagaggttctgggccccacatcctgtgcggtaaagataaggagaagtgcgggggtctgagaacacggaactgtgtcacggcatagctcctggggt

SEQ ID NO: 115633 - DNA, 201 bp, Bos taurus; identical to SEQ ID NO: 74207

SEQ ID NO: 115634 - DNA, 201 bp, Bos taurus
aaagttcaataagagaaaactctcgctgtcagcagttctttgctggtcatcactgttgttcgttccaattcatgattattcaagacaggaatttcagtgcmgtaggggagcgtcagctgcagccctggtgagctggggcctgggcagagccagccctgggcagtggtcagctcacaccccaccccgccaagcagacagagt

SEQ ID NO: 115635 - DNA, 201 bp, Bos taurus; identical to SEQ ID NO: 74208

SEQ ID NO: 115636 - DNA, 201 bp, Bos taurus; identical to SEQ ID NO: 34654

SEQ ID NO: 115637 - DNA, 201 bp, Bos taurus; identical to SEQ ID NO: 34655

SEQ ID NO: 115638 - DNA, 201 bp, Bos taurus; identical to SEQ ID NO: 34656

SEQ ID NO: 115639 - DNA, 201 bp, Bos taurus; identical to SEQ ID NO: 34657

SEQ ID NO: 115640 - DNA, 201 bp, Bos taurus; identical to SEQ ID NO: 34658

SEQ ID NO: 115641 - DNA, 201 bp, Bos taurus; identical to SEQ ID NO: 34659

SEQ ID NO: 115642 - DNA, 201 bp, Bos taurus; identical to SEQ ID NO: 34660

SEQ ID NO: 115643 - DNA, 201 bp, Bos taurus; identical to SEQ ID NO: 74216

SEQ ID NO: 115644 - DNA, 201 bp, Bos taurus
aattgtatgtccggcgaatctaaacttctcttgatcaggggaagggacctctgtgttgggtcaggtgagtgggaagggccatgagttggatgaggttataragagtttggggagttattttcagagaaacagtttactaaaaaggaagaataaagtctctttaaagaccatgatctctgctgtcatttggcctgggctgca

SEQ ID NO: 115645 - DNA, 201 bp, Bos taurus; identical to SEQ ID NO: 74217

SEQ ID NO: 115646 - DNA, 201 bp, Bos taurus; identical to SEQ ID NO: 74218

SEQ ID NO: 115647 - DNA, 201 bp, Bos taurus
tatgagagtttagagaatgcagttaatagaagtgctttagccaaaatgatagaatatcacattcagcctcaaatgaatggacttaattcaagtctcaacayagtatatggcagtccatccttgtgaaaatcatgctgtggctggtttggaatgggcttactgggtgacctacctggacagctggaaacctctcctggaaat

SEQ ID NO: 115648 - DNA, 201 bp, Bos taurus; identical to SEQ ID NO: 34662

SEQ ID NO: 115649 - DNA, 201 bp, Bos taurus; identical to SEQ ID NO: 34665

SEQ ID NO: 115650 - DNA, 201 bp, Bos taurus; identical to SEQ ID NO: 34666

SEQ ID NO: 115651 - DNA, 201 bp, Bos taurus
ccactgctctgcaagatcagctactctactgggctgagctaacagattacacagcggaacccgaacactgctgcctttatggtgttcttacaggccacctkccttcacagttcactcatccacagtctctgtctttgatttactgatccctttccactcatatgccccaatttttcttttctctccctcgcagctccctct

SEQ ID NO: 115652 - DNA, 201 bp, Bos taurus; identical to SEQ ID NO: 74225

SEQ ID NO: 115653 - DNA, 201 bp, Bos taurus; identical to SEQ ID NO: 34669

SEQ ID NO: 115654 - DNA, 201 bp, Bos taurus; identical to SEQ ID NO: 34670

SEQ ID NO: 115655 - DNA, 201 bp, Bos taurus; identical to SEQ ID NO: 34671

SEQ ID NO: 115656 - DNA, 201 bp, Bos taurus; identical to SEQ ID NO: 74231

SEQ ID NO: 115657 - DNA, 201 bp, Bos taurus; identical to SEQ ID NO: 34673

SEQ ID NO: 115658 - DNA, 201 bp, Bos taurus; identical to SEQ ID NO: 34674

SEQ ID NO: 115659 - DNA, 201 bp, Bos taurus
acgtggtcggggagatgaagataaagtcatccagtggccctcgggcccacaccttagagcctggcctctgactgctcactgggagaaggcccaccaggcargtggtccgtctgtgtctggaaacacagcgttcctgatgcagtgagattcttccagcccaaagggaggccaatgcgctgtgctgcccccagctaatcttca

SEQ ID NO: 115660 - DNA, 201 bp, Bos taurus
ttaaatactattacttgttaacatttgtattaaatcactgatactttactaattcatactagtttcaccagccatctgcccaaaattatgaatatatagtracagcatattttattacatgtaatacattttatgccatagtttctgaactcattatgttctcatggttcatcctgaatatacagtacaatattctgatgt

SEQ ID NO: 115661 - DNA, 201 bp, Bos taurus
gagagctctgaggcccccaccagctcttgcaaggtttgataagatgctgacaatgactacaacagaaaggagagaacagaagaaatgacagctccaaagaytctcaccagaggttaggccagaagccagaaaagtcacttgaccaccaagactggataaggagagcaaggtagacaggagaggaaggcgcgcgggaggtaa

SEQ ID NO: 115662 - DNA, 201 bp, Bos taurus
ctgtcacggtgagcctggccccgtggctgacccggacactggcgatgtttgaggccacacagtggaagacaccgctgtcctcagctcgaaggcctgtgatytgcaggactcccttgggcagcagcgtgtacctgtggtggggggcacggtcaaccaccagcacagcaccactggcccaaggacactcagcatcacggacac

SEQ ID NO: 115663 - DNA, 201 bp, Bos taurus
aacgactcaatattacaatcagaaaaacgaagtccagagagggtgactgacttgcccagttatgcaggacaccggtgtccaggcaagggcctttgcaccaygcctcacagcttctcaagagcatcagaagaggtcaggctgtggagtactgatttccacctacttctgcaccctggcatacttacagatgacctgcctggt

SEQ ID NO: 115664 - DNA, 201 bp, Bos taurus
tggcagtgtggccatgtttttgtctgtgcttgcacagaattatgaaatggctttatctcattttatcaaggtattctgttcttgtgtaatagcagagtaaygtgtcctagctgtgaatgccaggccagcttttgaatgtcaggggctgctcctttttaaaaacttcccaattaattgctccacgcatggcctgtggaactg

SEQ ID NO: 115665 - DNA, 201 bp, Bos taurus; identical to SEQ ID NO: 34675

SEQ ID NO: 115666 - DNA, 201 bp, Bos taurus
aaatgatagaaacagctgagagtctcaccatcctccttccacatcttgcctattgccccgcttcctcagagcgccgtctcggacacgctttgcaggccccraggggcgctctcaggtacactcctattctcttgggtcgcctctgtctctgggatgctggtgcagaactggagccaggcaggaggcccatcagagaaagct

SEQ ID NO: 115667 - DNA, 201 bp, Bos taurus; identical to SEQ ID NO: 34677

SEQ ID NO: 115668 - DNA, 201 bp, Bos taurus; identical to SEQ ID NO: 34678

SEQ ID NO: 115669 - DNA, 201 bp, Bos taurus; identical to SEQ ID NO: 34681

SEQ ID NO: 115670 - DNA, 201 bp, Bos taurus; identical to SEQ ID NO: 34684

SEQ ID NO: 115671 - DNA, 201 bp, Bos taurus; identical to SEQ ID NO: 34685

SEQ ID NO: 115672 - DNA, 201 bp, Bos taurus; identical to SEQ ID NO: 34686

SEQ ID NO: 115673 - DNA, 201 bp, Bos taurus; identical to SEQ ID NO: 74243

SEQ ID NO: 115674 - DNA, 201 bp, Bos taurus; identical to SEQ ID NO: 74244

SEQ ID NO: 115675 - DNA, 201 bp, Bos taurus
ttagcagccatattcctcagcttctataattctcactgggtgattgagatggtattgggtatgttcagggtggtatggccgtggactcattggagggattyagggggaaaaaaaatttcttgaaaaatatttggagcctttcaaaggtgtgatgtgagtttgagtgaactccgggagttggtgatgtacagggaggcctgc

SEQ ID NO: 115676 - DNA, 201 bp, Bos taurus; identical to SEQ ID NO: 34688

SEQ ID NO: 115677 - DNA, 201 bp, Bos taurus; identical to SEQ ID NO: 34689

SEQ ID NO: 115678 - DNA, 201 bp, Bos taurus; identical to SEQ ID NO: 34690

SEQ ID NO: 115679 - DNA, 201 bp, Bos taurus; identical to SEQ ID NO: 34691

SEQ ID NO: 115680 - DNA, 201 bp, Bos taurus; identical to SEQ ID NO: 34693

SEQ ID NO: 115681 - DNA, 201 bp, Bos taurus; identical to SEQ ID NO: 34694

SEQ ID NO: 115682 - DNA, 201 bp, Bos taurus; identical to SEQ ID NO: 34695

SEQ ID NO: 115683 - DNA, 201 bp, Bos taurus; identical to SEQ ID NO: 74249

SEQ ID NO: 115684 - DNA, 201 bp, Bos taurus; identical to SEQ ID NO: 74250

SEQ ID NO: 115685 - DNA, 201 bp, Bos taurus; identical to SEQ ID NO: 74251

SEQ ID NO: 115686 - DNA, 201 bp, Bos taurus; identical to SEQ ID NO: 74252

SEQ ID NO: 115687 - DNA, 201 bp, Bos taurus; identical to SEQ ID NO: 34701

SEQ ID NO: 115688 - DNA, 201 bp, Bos taurus; identical to SEQ ID NO: 74258

SEQ ID NO: 115689 - DNA, 201 bp, Bos taurus; identical to SEQ ID NO: 34703

SEQ ID NO: 115690 - DNA, 201 bp, Bos taurus
ccaggaacccagagtgtgcggcttccagccagtcccgcccccacaaggcggaagcttcagtcttgctgtccccacacggagccaggtggacacttctgagyaccttcgcgaaggctctgtggccccctcgcctcccacacgacctcacctctgtatgctgatgcggccagcaggccccacccgcccagccaccttcatttg

SEQ ID NO: 115691 - DNA, 201 bp, Bos taurus; identical to SEQ ID NO: 34705

SEQ ID NO: 115692 - DNA, 201 bp, Bos taurus; identical to SEQ ID NO: 74262

SEQ ID NO: 115693 - DNA, 201 bp, Bos taurus; identical to SEQ ID NO: 34708

SEQ ID NO: 115694 - DNA, 201 bp, Bos taurus; identical to SEQ ID NO: 34709

SEQ ID NO: 115695 - DNA, 201 bp, Bos taurus; identical to SEQ ID NO: 34710

SEQ ID NO: 115696 - DNA, 201 bp, Bos taurus; identical to SEQ ID NO: 34711

SEQ ID NO: 115697 - DNA, 201 bp, Bos taurus; identical to SEQ ID NO: 74263

SEQ ID NO: 115698 - DNA, 201 bp, Bos taurus; identical to SEQ ID NO: 74265

SEQ ID NO: 115699 - DNA, 201 bp, Bos taurus; identical to SEQ ID NO: 74266

SEQ ID NO: 115700 - DNA, 201 bp, Bos taurus; identical to SEQ ID NO: 34714

SEQ ID NO: 115701 - DNA, 201 bp, Bos taurus; identical to SEQ ID NO: 34715

SEQ ID NO: 115702 - DNA, 201 bp, Bos taurus; identical to SEQ ID NO: 34716

SEQ ID NO: 115703 - DNA, 201 bp, Bos taurus; identical to SEQ ID NO: 34718

SEQ ID NO: 115704 - DNA, 201 bp, Bos taurus; identical to SEQ ID NO: 34720

SEQ ID NO: 115705 - DNA, 201 bp, Bos taurus; identical to SEQ ID NO: 34721

SEQ ID NO: 115706 - DNA, 201 bp, Bos taurus; identical to SEQ ID NO: 74270

SEQ ID NO: 115707 - DNA, 201 bp, Bos taurus; identical to SEQ ID NO: 74278

SEQ ID NO: 115708 - DNA, 201 bp, Bos taurus; identical to SEQ ID NO: 74279

SEQ ID NO: 115709 - DNA, 201 bp, Bos taurus; identical to SEQ ID NO: 74280

SEQ ID NO: 115710 - DNA, 201 bp, Bos taurus; identical to SEQ ID NO: 74281

SEQ ID NO: 115711 - DNA, 201 bp, Bos taurus; identical to SEQ ID NO: 74282

SEQ ID NO: 115712 - DNA, 201 bp, Bos taurus; identical to SEQ ID NO: 34730

SEQ ID NO: 115713 - DNA, 201 bp, Bos taurus; identical to SEQ ID NO: 74284

SEQ ID NO: 115714 - DNA, 201 bp, Bos taurus; identical to SEQ ID NO: 34732

SEQ ID NO: 115715 - DNA, 201 bp, Bos taurus; identical to SEQ ID NO: 74287

SEQ ID NO: 115716 - DNA, 201 bp, Bos taurus; identical to SEQ ID NO: 34736

SEQ ID NO: 115717 - DNA, 201 bp, Bos taurus; identical to SEQ ID NO: 34737

SEQ ID NO: 115718 - DNA, 201 bp, Bos taurus; identical to SEQ ID NO: 34738

SEQ ID NO: 115719 - DNA, 201 bp, Bos taurus; identical to SEQ ID NO: 74290

SEQ ID NO: 115720 - DNA, 201 bp, Bos taurus; identical to SEQ ID NO: 74293

SEQ ID NO: 115721 - DNA, 201 bp, Bos taurus; identical to SEQ ID NO: 74295

SEQ ID NO: 115722 - DNA, 201 bp, Bos taurus; identical to SEQ ID NO: 34742

SEQ ID NO: 115723 - DNA, 201 bp, Bos taurus; identical to SEQ ID NO: 34743

SEQ ID NO: 115724 - DNA, 201 bp, Bos taurus; identical to SEQ ID NO: 34746

SEQ ID NO: 115725 - DNA, 201 bp, Bos taurus; identical to SEQ ID NO: 34747

SEQ ID NO: 115726 - DNA, 201 bp, Bos taurus; identical to SEQ ID NO: 34748

SEQ ID NO: 115727 - DNA, 201 bp, Bos taurus; identical to SEQ ID NO: 34749

SEQ ID NO: 115728 - DNA, 201 bp, Bos taurus; identical to SEQ ID NO: 34750

SEQ ID NO: 115729 - DNA, 201 bp, Bos taurus; identical to SEQ ID NO: 34751

SEQ ID NO: 115730 - DNA, 201 bp, Bos taurus; identical to SEQ ID NO: 34752

SEQ ID NO: 115731 - DNA, 201 bp, Bos taurus; identical to SEQ ID NO: 34753

SEQ ID NO: 115732 - DNA, 201 bp, Bos taurus; identical to SEQ ID NO: 34754

SEQ ID NO: 115733 - DNA, 201 bp, Bos taurus; identical to SEQ ID NO: 34755

SEQ ID NO: 115734 - DNA, 201 bp, Bos taurus; identical to SEQ ID NO: 34756

SEQ ID NO: 115735 - DNA, 201 bp, Bos taurus; identical to SEQ ID NO: 34757

SEQ ID NO: 115736 - DNA, 201 bp, Bos taurus; identical to SEQ ID NO: 34758

SEQ ID NO: 115737 - DNA, 201 bp, Bos taurus; identical to SEQ ID NO: 34759

SEQ ID NO: 115738 - DNA, 201 bp, Bos taurus; identical to SEQ ID NO: 34760

SEQ ID NO: 115739 - DNA, 201 bp, Bos taurus; identical to SEQ ID NO: 34761

SEQ ID NO: 115740 - DNA, 201 bp, Bos taurus; identical to SEQ ID NO: 34762

SEQ ID NO: 115741 - DNA, 201 bp, Bos taurus; identical to SEQ ID NO: 34763

SEQ ID NO: 115742 - DNA, 201 bp, Bos taurus; identical to SEQ ID NO: 34764

SEQ ID NO: 115743 - DNA, 201 bp, Bos taurus; identical to SEQ ID NO: 34765

SEQ ID NO: 115744 - DNA, 201 bp, Bos taurus; identical to SEQ ID NO: 34766

SEQ ID NO: 115745 - DNA, 201 bp, Bos taurus; identical to SEQ ID NO: 34767

SEQ ID NO: 115746 - DNA, 201 bp, Bos taurus; identical to SEQ ID NO: 34768

SEQ ID NO: 115747 - DNA, 201 bp, Bos taurus; identical to SEQ ID NO: 34769

SEQ ID NO: 115748 - DNA, 201 bp, Bos taurus; identical to SEQ ID NO: 34770

SEQ ID NO: 115749 - DNA, 201 bp, Bos taurus; identical to SEQ ID NO: 34771

SEQ ID NO: 115750 - DNA, 201 bp, Bos taurus; identical to SEQ ID NO: 34772

SEQ ID NO: 115751 - DNA, 201 bp, Bos taurus; identical to SEQ ID NO: 34773

SEQ ID NO: 115752 - DNA, 201 bp, Bos taurus; identical to SEQ ID NO: 34774

SEQ ID NO: 115753 - DNA, 201 bp, Bos taurus; identical to SEQ ID NO: 34775

SEQ ID NO: 115754 - DNA, 201 bp, Bos taurus; identical to SEQ ID NO: 34776

SEQ ID NO: 115755 - DNA, 201 bp, Bos taurus; identical to SEQ ID NO: 34777

SEQ ID NO: 115756 - DNA, 201 bp, Bos taurus; identical to SEQ ID NO: 34778

SEQ ID NO: 115757 - DNA, 201 bp, Bos taurus; identical to SEQ ID NO: 34779

SEQ ID NO: 115758 - DNA, 201 bp, Bos taurus; identical to SEQ ID NO: 34780

SEQ ID NO: 115759 - DNA, 201 bp, Bos taurus; identical to SEQ ID NO: 34781

SEQ ID NO: 115760 - DNA, 201 bp, Bos taurus; identical to SEQ ID NO: 34782

SEQ ID NO: 115761 - DNA, 201 bp, Bos taurus; identical to SEQ ID NO: 34784

SEQ ID NO: 115762 - DNA, 201 bp, Bos taurus; identical to SEQ ID NO: 34785

SEQ ID NO: 115763 - DNA, 201 bp, Bos taurus; identical to SEQ ID NO: 34786

SEQ ID NO: 115764 - DNA, 201 bp, Bos taurus; identical to SEQ ID NO: 34787

SEQ ID NO: 115765 - DNA, 201 bp, Bos taurus; identical to SEQ ID NO: 34788

SEQ ID NO: 115766 - DNA, 201 bp, Bos taurus; identical to SEQ ID NO: 34789

SEQ ID NO: 115767 - DNA, 201 bp, Bos taurus; identical to SEQ ID NO: 74345

SEQ ID NO: 115768 - DNA, 201 bp, Bos taurus; identical to SEQ ID NO: 34790

SEQ ID NO: 115769 - DNA, 201 bp, Bos taurus; identical to SEQ ID NO: 34791

SEQ ID NO: 115770 - DNA, 201 bp, Bos taurus; identical to SEQ ID NO: 34792

SEQ ID NO: 115771 - DNA, 201 bp, Bos taurus; identical to SEQ ID NO: 34793

SEQ ID NO: 115772 - DNA, 201 bp, Bos taurus; identical to SEQ ID NO: 34794

SEQ ID NO: 115773 - DNA, 201 bp, Bos taurus; identical to SEQ ID NO: 34795

SEQ ID NO: 115774 - DNA, 201 bp, Bos taurus; identical to SEQ ID NO: 34796

SEQ ID NO: 115775 - DNA, 201 bp, Bos taurus; identical to SEQ ID NO: 34797

SEQ ID NO: 115776 - DNA, 201 bp, Bos taurus; identical to SEQ ID NO: 34798

SEQ ID NO: 115777 - DNA, 201 bp, Bos taurus; identical to SEQ ID NO: 34799

SEQ ID NO: 115778 - DNA, 201 bp, Bos taurus; identical to SEQ ID NO: 34800

SEQ ID NO: 115779 - DNA, 201 bp, Bos taurus; identical to SEQ ID NO: 34801

SEQ ID NO: 115780 - DNA, 201 bp, Bos taurus; identical to SEQ ID NO: 34802

SEQ ID NO: 115781 - DNA, 201 bp, Bos taurus; identical to SEQ ID NO: 34803

SEQ ID NO: 115782 - DNA, 201 bp, Bos taurus; identical to SEQ ID NO: 34804

SEQ ID NO: 115783 - DNA, 201 bp, Bos taurus; identical to SEQ ID NO: 34805

SEQ ID NO: 115784 - DNA, 201 bp, Bos taurus; identical to SEQ ID NO: 34806

SEQ ID NO: 115785 - DNA, 201 bp, Bos taurus; identical to SEQ ID NO: 34807

SEQ ID NO: 115786 - DNA, 201 bp, Bos taurus; identical to SEQ ID NO: 34808

SEQ ID NO: 115787 - DNA, 201 bp, Bos taurus; identical to SEQ ID NO: 34809

SEQ ID NO: 115788 - DNA, 201 bp, Bos taurus; identical to SEQ ID NO: 34810

SEQ ID NO: 115789 - DNA, 201 bp, Bos taurus; identical to SEQ ID NO: 34811

SEQ ID NO: 115790 - DNA, 201 bp, Bos taurus; identical to SEQ ID NO: 34812

SEQ ID NO: 115791 - DNA, 201 bp, Bos taurus; identical to SEQ ID NO: 34813

SEQ ID NO: 115792 - DNA, 201 bp, Bos taurus; identical to SEQ ID NO: 34814

SEQ ID NO: 115793 - DNA, 201 bp, Bos taurus; identical to SEQ ID NO: 34815

SEQ ID NO: 115794 - DNA, 201 bp, Bos taurus; identical to SEQ ID NO: 34816

SEQ ID NO: 115795 - DNA, 201 bp, Bos taurus; identical to SEQ ID NO: 34817

SEQ ID NO: 115796 - DNA, 201 bp, Bos taurus; identical to SEQ ID NO: 34818

SEQ ID NO: 115797 - DNA, 201 bp, Bos taurus; identical to SEQ ID NO: 34819

SEQ ID NO: 115798 - DNA, 201 bp, Bos taurus; identical to SEQ ID NO: 34820

SEQ ID NO: 115799 - DNA, 201 bp, Bos taurus; identical to SEQ ID NO: 34821

SEQ ID NO: 115800 - DNA, 201 bp, Bos taurus; identical to SEQ ID NO: 34823

SEQ ID NO: 115801 - DNA, 201 bp, Bos taurus; identical to SEQ ID NO: 34824

SEQ ID NO: 115802 - DNA, 201 bp, Bos taurus; identical to SEQ ID NO: 34826

SEQ ID NO: 115803 - DNA, 201 bp, Bos taurus; identical to SEQ ID NO: 34827

SEQ ID NO: 115804 - DNA, 201 bp, Bos taurus; identical to SEQ ID NO: 34828

SEQ ID NO: 115805 - DNA, 201 bp, Bos taurus; identical to SEQ ID NO: 34829

SEQ ID NO: 115806 - DNA, 201 bp, Bos taurus; identical to SEQ ID NO: 34830

SEQ ID NO: 115807 - DNA, 201 bp, Bos taurus; identical to SEQ ID NO: 34831

SEQ ID NO: 115808 - DNA, 201 bp, Bos taurus; identical to SEQ ID NO: 34832

SEQ ID NO: 115809 - DNA, 201 bp, Bos taurus; identical to SEQ ID NO: 34833

SEQ ID NO: 115810 - DNA, 201 bp, Bos taurus; identical to SEQ ID NO: 34834

SEQ ID NO: 115811 - DNA, 201 bp, Bos taurus; identical to SEQ ID NO: 34835

SEQ ID NO: 115812 - DNA, 201 bp, Bos taurus; identical to SEQ ID NO: 34836

SEQ ID NO: 115813 - DNA, 201 bp, Bos taurus; identical to SEQ ID NO: 34837

SEQ ID NO: 115814 - DNA, 201 bp, Bos taurus; identical to SEQ ID NO: 34838

SEQ ID NO: 115815 - DNA, 201 bp, Bos taurus; identical to SEQ ID NO: 34839

SEQ ID NO: 115816 - DNA, 201 bp, Bos taurus; identical to SEQ ID NO: 34840

SEQ ID NO: 115817 - DNA, 201 bp, Bos taurus; identical to SEQ ID NO: 34841

SEQ ID NO: 115818 - DNA, 201 bp, Bos taurus; identical to SEQ ID NO: 34842

SEQ ID NO: 115819 - DNA, 201 bp, Bos taurus; identical to SEQ ID NO: 34843

SEQ ID NO: 115820 - DNA, 201 bp, Bos taurus; identical to SEQ ID NO: 34844

SEQ ID NO: 115821 - DNA, 201 bp, Bos taurus; identical to SEQ ID NO: 34845

SEQ ID NO: 115822 - DNA, 201 bp, Bos taurus; identical to SEQ ID NO: 34846

SEQ ID NO: 115823 - DNA, 201 bp, Bos taurus; identical to SEQ ID NO: 34847

SEQ ID NO: 115824 - DNA, 201 bp, Bos taurus; identical to SEQ ID NO: 34848

SEQ ID NO: 115825 - DNA, 201 bp, Bos taurus; identical to SEQ ID NO: 34849

SEQ ID NO: 115826 - DNA, 201 bp, Bos taurus; identical to SEQ ID NO: 34850

SEQ ID NO: 115827 - DNA, 201 bp, Bos taurus; identical to SEQ ID NO: 34851

SEQ ID NO: 115828 - DNA, 201 bp, Bos taurus; identical to SEQ ID NO: 34852

SEQ ID NO: 115829 - DNA, 201 bp, Bos taurus; identical to SEQ ID NO: 34853

SEQ ID NO: 115830 - DNA, 201 bp, Bos taurus; identical to SEQ ID NO: 34854

SEQ ID NO: 115831 - DNA, 201 bp, Bos taurus; identical to SEQ ID NO: 34855

SEQ ID NO: 115832 - DNA, 201 bp, Bos taurus; identical to SEQ ID NO: 34856

SEQ ID NO: 115833 - DNA, 201 bp, Bos taurus; identical to SEQ ID NO: 34857

SEQ ID NO: 115834 - DNA, 201 bp, Bos taurus; identical to SEQ ID NO: 34858

SEQ ID NO: 115835 - DNA, 201 bp, Bos taurus; identical to SEQ ID NO: 34859

SEQ ID NO: 115836 - DNA, 201 bp, Bos taurus; identical to SEQ ID NO: 34860

SEQ ID NO: 115837 - DNA, 201 bp, Bos taurus; identical to SEQ ID NO: 34861

SEQ ID NO: 115838 - DNA, 201 bp, Bos taurus; identical to SEQ ID NO: 34862

SEQ ID NO: 115839 - DNA, 201 bp, Bos taurus; identical to SEQ ID NO: 34863

SEQ ID NO: 115840 - DNA, 201 bp, Bos taurus; identical to SEQ ID NO: 34864

SEQ ID NO: 115841 - DNA, 201 bp, Bos taurus; identical to SEQ ID NO: 34865

SEQ ID NO: 115842 - DNA, 201 bp, Bos taurus; identical to SEQ ID NO: 34866

SEQ ID NO: 115843 - DNA, 201 bp, Bos taurus; identical to SEQ ID NO: 34867

SEQ ID NO: 115844 - DNA, 201 bp, Bos taurus; identical to SEQ ID NO: 34868

SEQ ID NO: 115845 - DNA, 201 bp, Bos taurus; identical to SEQ ID NO: 34869

SEQ ID NO: 115846 - DNA, 201 bp, Bos taurus; identical to SEQ ID NO: 34870

SEQ ID NO: 115847 - DNA, 201 bp, Bos taurus; identical to SEQ ID NO: 34871

SEQ ID NO: 115848 - DNA, 201 bp, Bos taurus; identical to SEQ ID NO: 34872

SEQ ID NO: 115849 - DNA, 201 bp, Bos taurus; identical to SEQ ID NO: 34873

SEQ ID NO: 115850 - DNA, 201 bp, Bos taurus; identical to SEQ ID NO: 34874

SEQ ID NO: 115851 - DNA, 201 bp, Bos taurus; identical to SEQ ID NO: 34875

SEQ ID NO: 115852 - DNA, 201 bp, Bos taurus; identical to SEQ ID NO: 34876

SEQ ID NO: 115853 - DNA, 201 bp, Bos taurus; identical to SEQ ID NO: 34877

SEQ ID NO: 115854 - DNA, 201 bp, Bos taurus; identical to SEQ ID NO: 34878

SEQ ID NO: 115855 - DNA, 201 bp, Bos taurus; identical to SEQ ID NO: 34879

SEQ ID NO: 115856 - DNA, 201 bp, Bos taurus; identical to SEQ ID NO: 34880

SEQ ID NO: 115857 - DNA, 201 bp, Bos taurus; identical to SEQ ID NO: 34881

SEQ ID NO: 115858 - DNA, 201 bp, Bos taurus; identical to SEQ ID NO: 34882

SEQ ID NO: 115859 - DNA, 201 bp, Bos taurus; identical to SEQ ID NO: 34883

SEQ ID NO: 115860 - DNA, 201 bp, Bos taurus; identical to SEQ ID NO: 74437

SEQ ID NO: 115861 - DNA, 201 bp, Bos taurus; identical to SEQ ID NO: 34884

SEQ ID NO: 115862 - DNA, 201 bp, Bos taurus; identical to SEQ ID NO: 34885

SEQ ID NO: 115863 - DNA, 201 bp, Bos taurus; identical to SEQ ID NO: 34886

SEQ ID NO: 115864 - DNA, 201 bp, Bos taurus; identical to SEQ ID NO: 34887

SEQ ID NO: 115865 - DNA, 201 bp, Bos taurus; identical to SEQ ID NO: 34888

SEQ ID NO: 115866 - DNA, 201 bp, Bos taurus; identical to SEQ ID NO: 34889

SEQ ID NO: 115867 - DNA, 201 bp, Bos taurus; identical to SEQ ID NO: 34890

SEQ ID NO: 115868 - DNA, 201 bp, Bos taurus; identical to SEQ ID NO: 34891

SEQ ID NO: 115869 - DNA, 201 bp, Bos taurus; identical to SEQ ID NO: 34892

SEQ ID NO: 115870 - DNA, 201 bp, Bos taurus; identical to SEQ ID NO: 34893

SEQ ID NO: 115871 - DNA, 201 bp, Bos taurus; identical to SEQ ID NO: 34894

SEQ ID NO: 115872 - DNA, 201 bp, Bos taurus; identical to SEQ ID NO: 34895

SEQ ID NO: 115873 - DNA, 201 bp, Bos taurus; identical to SEQ ID NO: 34896

SEQ ID NO: 115874 - DNA, 201 bp, Bos taurus; identical to SEQ ID NO: 34897

SEQ ID NO: 115875 - DNA, 201 bp, Bos taurus; identical to SEQ ID NO: 34898

SEQ ID NO: 115876 - DNA, 201 bp, Bos taurus; identical to SEQ ID NO: 34899

SEQ ID NO: 115877 - DNA, 201 bp, Bos taurus; identical to SEQ ID NO: 34900

SEQ ID NO: 115878 - DNA, 201 bp, Bos taurus; identical to SEQ ID NO: 34901

SEQ ID NO: 115879 - DNA, 201 bp, Bos taurus; identical to SEQ ID NO: 34902

SEQ ID NO: 115880 - DNA, 201 bp, Bos taurus; identical to SEQ ID NO: 34903

SEQ ID NO: 115881 - DNA, 201 bp, Bos taurus; identical to SEQ ID NO: 34904

SEQ ID NO: 115882 - DNA, 201 bp, Bos taurus; identical to SEQ ID NO: 34905

SEQ ID NO: 115883 - DNA, 201 bp, Bos taurus; identical to SEQ ID NO: 34906

SEQ ID NO: 115884 - DNA, 201 bp, Bos taurus; identical to SEQ ID NO: 34907

SEQ ID NO: 115885 - DNA, 201 bp, Bos taurus; identical to SEQ ID NO: 34908

SEQ ID NO: 115886 - DNA, 201 bp, Bos taurus; identical to SEQ ID NO: 34909

SEQ ID NO: 115887 - DNA, 201 bp, Bos taurus; identical to SEQ ID NO: 34910

SEQ ID NO: 115888 - DNA, 201 bp, Bos taurus; identical to SEQ ID NO: 34911

SEQ ID NO: 115889 - DNA, 201 bp, Bos taurus; identical to SEQ ID NO: 34913

SEQ ID NO: 115890 - DNA, 201 bp, Bos taurus; identical to SEQ ID NO: 34914

SEQ ID NO: 115891 - DNA, 201 bp, Bos taurus; identical to SEQ ID NO: 34915

SEQ ID NO: 115892 - DNA, 201 bp, Bos taurus; identical to SEQ ID NO: 34916

SEQ ID NO: 115893 - DNA, 201 bp, Bos taurus; identical to SEQ ID NO: 34917

SEQ ID NO: 115894 - DNA, 201 bp, Bos taurus; identical to SEQ ID NO: 34918

SEQ ID NO: 115895 - DNA, 201 bp, Bos taurus; identical to SEQ ID NO: 34920

SEQ ID NO: 115896 - DNA, 201 bp, Bos taurus; identical to SEQ ID NO: 34921

SEQ ID NO: 115897 - DNA, 201 bp, Bos taurus; identical to SEQ ID NO: 34922

SEQ ID NO: 115898 - DNA, 201 bp, Bos taurus; identical to SEQ ID NO: 34924

SEQ ID NO: 115899 - DNA, 201 bp, Bos taurus; identical to SEQ ID NO: 34925

SEQ ID NO: 115900 - DNA, 201 bp, Bos taurus; identical to SEQ ID NO: 34926

SEQ ID NO: 115901 - DNA, 201 bp, Bos taurus; identical to SEQ ID NO: 34927

SEQ ID NO: 115902 - DNA, 201 bp, Bos taurus; identical to SEQ ID NO: 34928

SEQ ID NO: 115903 - DNA, 201 bp, Bos taurus; identical to SEQ ID NO: 34929

SEQ ID NO: 115904 - DNA, 201 bp, Bos taurus; identical to SEQ ID NO: 34930

SEQ ID NO: 115905 - DNA, 201 bp, Bos taurus; identical to SEQ ID NO: 34931

SEQ ID NO: 115906 - DNA, 201 bp, Bos taurus; identical to SEQ ID NO: 34932

SEQ ID NO: 115907 - DNA, 201 bp, Bos taurus; identical to SEQ ID NO: 34933

SEQ ID NO: 115908 - DNA, 201 bp, Bos taurus; identical to SEQ ID NO: 34934

SEQ ID NO: 115909 - DNA, 201 bp, Bos taurus; identical to SEQ ID NO: 34935

SEQ ID NO: 115910 - DNA, 201 bp, Bos taurus; identical to SEQ ID NO: 34936

SEQ ID NO: 115911 - DNA, 201 bp, Bos taurus; identical to SEQ ID NO: 34937

SEQ ID NO: 115912 - DNA, 201 bp, Bos taurus; identical to SEQ ID NO: 34938

SEQ ID NO: 115913 - DNA, 201 bp, Bos taurus; identical to SEQ ID NO: 34939

SEQ ID NO: 115914 - DNA, 201 bp, Bos taurus; identical to SEQ ID NO: 34940

SEQ ID NO: 115915 - DNA, 201 bp, Bos taurus; identical to SEQ ID NO: 34941

SEQ ID NO: 115916 - DNA, 201 bp, Bos taurus; identical to SEQ ID NO: 34942

SEQ ID NO: 115917 - DNA, 201 bp, Bos taurus; identical to SEQ ID NO: 34943

SEQ ID NO: 115918 - DNA, 201 bp, Bos taurus; identical to SEQ ID NO: 34944

SEQ ID NO: 115919 - DNA, 201 bp, Bos taurus; identical to SEQ ID NO: 34945

SEQ ID NO: 115920 - DNA, 201 bp, Bos taurus; identical to SEQ ID NO: 34946

SEQ ID NO: 115921 - DNA, 201 bp, Bos taurus; identical to SEQ ID NO: 34947

SEQ ID NO: 115922 - DNA, 201 bp, Bos taurus; identical to SEQ ID NO: 34949

SEQ ID NO: 115923 - DNA, 201 bp, Bos taurus; identical to SEQ ID NO: 34950

SEQ ID NO: 115924 - DNA, 201 bp, Bos taurus; identical to SEQ ID NO: 34951

SEQ ID NO: 115925 - DNA, 201 bp, Bos taurus; identical to SEQ ID NO: 34952

SEQ ID NO: 115926 - DNA, 201 bp, Bos taurus; identical to SEQ ID NO: 34953

SEQ ID NO: 115927 - DNA, 201 bp, Bos taurus; identical to SEQ ID NO: 34954

SEQ ID NO: 115928 - DNA, 201 bp, Bos taurus; identical to SEQ ID NO: 34955

SEQ ID NO: 115929 - DNA, 201 bp, Bos taurus; identical to SEQ ID NO: 34956

SEQ ID NO: 115930 - DNA, 201 bp, Bos taurus; identical to SEQ ID NO: 34957

SEQ ID NO: 115931 - DNA, 201 bp, Bos taurus; identical to SEQ ID NO: 34958

SEQ ID NO: 115932 - DNA, 201 bp, Bos taurus; identical to SEQ ID NO: 34959

SEQ ID NO: 115933 - DNA, 201 bp, Bos taurus; identical to SEQ ID NO: 34960

SEQ ID NO: 115934 - DNA, 201 bp, Bos taurus; identical to SEQ ID NO: 34961

SEQ ID NO: 115935 - DNA, 201 bp, Bos taurus; identical to SEQ ID NO: 34962

SEQ ID NO: 115936 - DNA, 201 bp, Bos taurus; identical to SEQ ID NO: 34963

SEQ ID NO: 115937 - DNA, 201 bp, Bos taurus; identical to SEQ ID NO: 34964

SEQ ID NO: 115938 - DNA, 201 bp, Bos taurus; identical to SEQ ID NO: 34965

SEQ ID NO: 115939 - DNA, 201 bp, Bos taurus; identical to SEQ ID NO: 34966

SEQ ID NO: 115940 - DNA, 201 bp, Bos taurus; identical to SEQ ID NO: 34967

SEQ ID NO: 115941 - DNA, 201 bp, Bos taurus; identical to SEQ ID NO: 34968

SEQ ID NO: 115942 - DNA, 201 bp, Bos taurus; identical to SEQ ID NO: 34969

SEQ ID NO: 115943 - DNA, 201 bp, Bos taurus; identical to SEQ ID NO: 34970

SEQ ID NO: 115944 - DNA, 201 bp, Bos taurus; identical to SEQ ID NO: 34971

SEQ ID NO: 115945 - DNA, 201 bp, Bos taurus; identical to SEQ ID NO: 34972

SEQ ID NO: 115946 - DNA, 201 bp, Bos taurus; identical to SEQ ID NO: 34973

SEQ ID NO: 115947 - DNA, 201 bp, Bos taurus; identical to SEQ ID NO: 34974

SEQ ID NO: 115948 - DNA, 201 bp, Bos taurus; identical to SEQ ID NO: 34975

SEQ ID NO: 115949 - DNA, 201 bp, Bos taurus; identical to SEQ ID NO: 34976

SEQ ID NO: 115950 - DNA, 201 bp, Bos taurus; identical to SEQ ID NO: 34977

SEQ ID NO: 115951 - DNA, 201 bp, Bos taurus; identical to SEQ ID NO: 34978

SEQ ID NO: 115952 - DNA, 201 bp, Bos taurus; identical to SEQ ID NO: 34979

SEQ ID NO: 115953 - DNA, 201 bp, Bos taurus; identical to SEQ ID NO: 34980

SEQ ID NO: 115954 - DNA, 201 bp, Bos taurus; identical to SEQ ID NO: 34981

SEQ ID NO: 115955 - DNA, 201 bp, Bos taurus; identical to SEQ ID NO: 34982

SEQ ID NO: 115956 - DNA, 201 bp, Bos taurus; identical to SEQ ID NO: 34983

SEQ ID NO: 115957 - DNA, 201 bp, Bos taurus; identical to SEQ ID NO: 34984

SEQ ID NO: 115958 - DNA, 201 bp, Bos taurus; identical to SEQ ID NO: 34985

SEQ ID NO: 115959 - DNA, 201 bp, Bos taurus; identical to SEQ ID NO: 34986

SEQ ID NO: 115960 - DNA, 201 bp, Bos taurus; identical to SEQ ID NO: 34988

SEQ ID NO: 115961 - DNA, 201 bp, Bos taurus; identical to SEQ ID NO: 34989

SEQ ID NO: 115962 - DNA, 201 bp, Bos taurus; identical to SEQ ID NO: 34990

SEQ ID NO: 115963 - DNA, 201 bp, Bos taurus; identical to SEQ ID NO: 34991

SEQ ID NO: 115964 - DNA, 201 bp, Bos taurus; identical to SEQ ID NO: 34993

SEQ ID NO: 115965 - DNA, 201 bp, Bos taurus; identical to SEQ ID NO: 34994

SEQ ID NO: 115966 - DNA, 201 bp, Bos taurus; identical to SEQ ID NO: 34995

SEQ ID NO: 115967 - DNA, 201 bp, Bos taurus; identical to SEQ ID NO: 34996

SEQ ID NO: 115968 - DNA, 201 bp, Bos taurus; identical to SEQ ID NO: 34997

SEQ ID NO: 115969 - DNA, 201 bp, Bos taurus; identical to SEQ ID NO: 34998

SEQ ID NO: 115970 - DNA, 201 bp, Bos taurus; identical to SEQ ID NO: 34999

SEQ ID NO: 115971 - DNA, 201 bp, Bos taurus; identical to SEQ ID NO: 35000

SEQ ID NO: 115972 - DNA, 201 bp, Bos taurus; identical to SEQ ID NO: 35001

SEQ ID NO: 115973 - DNA, 201 bp, Bos taurus; identical to SEQ ID NO: 35002

SEQ ID NO: 115974 - DNA, 201 bp, Bos taurus; identical to SEQ ID NO: 35003

SEQ ID NO: 115975 - DNA, 201 bp, Bos taurus; identical to SEQ ID NO: 35004

SEQ ID NO: 115976 - DNA, 201 bp, Bos taurus; identical to SEQ ID NO: 35005

SEQ ID NO: 115977 - DNA, 201 bp, Bos taurus; identical to SEQ ID NO: 35006

SEQ ID NO: 115978 - DNA, 201 bp, Bos taurus; identical to SEQ ID NO: 35007

SEQ ID NO: 115979 - DNA, 201 bp, Bos taurus; identical to SEQ ID NO: 35008

SEQ ID NO: 115980 - DNA, 201 bp, Bos taurus; identical to SEQ ID NO: 35009

SEQ ID NO: 115981 - DNA, 201 bp, Bos taurus; identical to SEQ ID NO: 35010

SEQ ID NO: 115982 - DNA, 201 bp, Bos taurus; identical to SEQ ID NO: 35011

SEQ ID NO: 115983 - DNA, 201 bp, Bos taurus; identical to SEQ ID NO: 35012

SEQ ID NO: 115984 - DNA, 201 bp, Bos taurus; identical to SEQ ID NO: 35013

SEQ ID NO: 115985 - DNA, 201 bp, Bos taurus; identical to SEQ ID NO: 35014

SEQ ID NO: 115986 - DNA, 201 bp, Bos taurus; identical to SEQ ID NO: 35015

SEQ ID NO: 115987 - DNA, 201 bp, Bos taurus; identical to SEQ ID NO: 35016

SEQ ID NO: 115988 - DNA, 201 bp, Bos taurus; identical to SEQ ID NO: 35017

SEQ ID NO: 115989 - DNA, 201 bp, Bos taurus; identical to SEQ ID NO: 35018

SEQ ID NO: 115990 - DNA, 201 bp, Bos taurus; identical to SEQ ID NO: 35019

SEQ ID NO: 115991 - DNA, 201 bp, Bos taurus; identical to SEQ ID NO: 35020

SEQ ID NO: 115992 - DNA, 201 bp, Bos taurus; identical to SEQ ID NO: 35021

SEQ ID NO: 115993 - DNA, 201 bp, Bos taurus; identical to SEQ ID NO: 35022

SEQ ID NO: 115994 - DNA, 201 bp, Bos taurus; identical to SEQ ID NO: 35023

SEQ ID NO: 115995 - DNA, 201 bp, Bos taurus; identical to SEQ ID NO: 35024

SEQ ID NO: 115996 - DNA, 201 bp, Bos taurus; identical to SEQ ID NO: 35025

SEQ ID NO: 115997 - DNA, 201 bp, Bos taurus; identical to SEQ ID NO: 35026

SEQ ID NO: 115998 - DNA, 201 bp, Bos taurus; identical to SEQ ID NO: 35027

SEQ ID NO: 115999 - DNA, 201 bp, Bos taurus; identical to SEQ ID NO: 35028

SEQ ID NO: 116000 - DNA, 201 bp, Bos taurus; identical to SEQ ID NO: 35029

SEQ ID NO: 116001 - DNA, 201 bp, Bos taurus; identical to SEQ ID NO: 35030

SEQ ID NO: 116002 - DNA, 201 bp, Bos taurus; identical to SEQ ID NO: 74569

SEQ ID NO: 116003 - DNA, 201 bp, Bos taurus; identical to SEQ ID NO: 35031

SEQ ID NO: 116004 - DNA, 201 bp, Bos taurus; identical to SEQ ID NO: 35033

SEQ ID NO: 116005 - DNA, 201 bp, Bos taurus; identical to SEQ ID NO: 35034

SEQ ID NO: 116006 - DNA, 201 bp, Bos taurus; identical to SEQ ID NO: 35035

SEQ ID NO: 116007 - DNA, 201 bp, Bos taurus; identical to SEQ ID NO: 35036

SEQ ID NO: 116008 - DNA, 201 bp, Bos taurus; identical to SEQ ID NO: 35037

SEQ ID NO: 116009 - DNA, 201 bp, Bos taurus
atctatggtaggatacttacgttaagaaaaactctaaatttttaggtaaatttagaataatgaagaacctttaaccttaaaagctcttgagtgttctccgmagtcctcttcaaaatcactgaaaaatgctgccatttactaaggtgtgcttctttaattaaacttgcttgttttcatgtcccagcatttgagatactaaga

SEQ ID NO: 116010 - DNA, 201 bp, Bos taurus; identical to SEQ ID NO: 35038

SEQ ID NO: 116011 - DNA, 201 bp, Bos taurus; identical to SEQ ID NO: 35039

SEQ ID NO: 116012 - DNA, 201 bp, Bos taurus; identical to SEQ ID NO: 35040

SEQ ID NO: 116013 - DNA, 201 bp, Bos taurus
gtctgactcttagtgatcccatggactgcagcccaccaggctcctccgtccatgggattttccaggcaagagtactggagtggggtgctattgccttctcygaatacagtaattatttgttctcattcatgtacaatattctactgtaaaaaacagaggtaaattctacaagcataatgttaagcaaaagaagccaagcac

SEQ ID NO: 116014 - DNA, 201 bp, Bos taurus; identical to SEQ ID NO: 74586

SEQ ID NO: 116015 - DNA, 201 bp, Bos taurus
gaccttgggaatgtgctacccagaatactgctaaggagagtataggagaccagtgtccctccctgaatccaacatgggccagattcatccatcctgtcccyggttcatgactgagcacttgaagataaccagtggtgttcattcctacagcagggggccctcctctaatggtcagcattgacttaatacctcctatcagcc

SEQ ID NO: 116016 - DNA, 201 bp, Bos taurus; identical to SEQ ID NO: 35044

SEQ ID NO: 116017 - DNA, 201 bp, Bos taurus
gatttcagaggccatagaaaagtaatgttatcaaaatttggtgagacctggagcatgaataaagggcttttttcccactcaagctgttagaaactaagccyggtttatggaacggaagagattacaagaagcaaagccatgttttctttaaaacaagtcttatatagcaaagcatctacctgtctgtgtgatatttgcatg

SEQ ID NO: 116018 - DNA, 201 bp, Bos taurus
gagaaatgcaaagagatccatagacagacacatcagaattaaaatgttgaaaggcaaagggaatattttaagaggagtaagagaaaaaggactggccacayacaagaaaaccacaataagataacacattattaaccaggggatttttgcaggaattcatgcctgtggccagtgatttgtatgtaagtgaatactgaaaca

SEQ ID NO: 116019 - DNA, 201 bp, Bos taurus; identical to SEQ ID NO: 35048

SEQ ID NO: 116020 - DNA, 201 bp, Bos taurus
ctcagttatgagcttagtcagccttaaggtggaagaagtggagcgaatgtgcagtgctttgcaaagtactctagttggctctctagtggcctgggtccctraggctgcctgttaatttacatgcaaactgagcacatgtctgcaggacagcagatggaatagtcaacaaccatcatccaccaaattattaaggccatgtct

SEQ ID NO: 116021 - DNA, 201 bp, Bos taurus
tgtatttcattttcaatacagaaatctttaattacagccaatctctttttgaatagcttttggtgatgaaaaatccattatttcactaaatggcctattgyttttgaggatttataattgttaggaggttcttcactgtgatgaactgaaatctattttttaattaattgaggtatttttgagggggcccctcaccccaca

SEQ ID NO: 116022 - DNA, 201 bp, Bos taurus
accctttatgatgtgatcagcgctgtgactggccacacgggttaccaagtgcaatgttgtgtggtgctctcagagggtcaggagggcttgggctgactgtyctgggccactgcaagaacccatctgcgtgggtgggatggacatgggagaagagggacccagcaggactgtgcctgcttcatcagtgactgtccaactgga

SEQ ID NO: 116023 - DNA, 201 bp, Bos taurus; identical to SEQ ID NO: 35051

SEQ ID NO: 116024 - DNA, 201 bp, Bos taurus; identical to SEQ ID NO: 35052

SEQ ID NO: 116025 - DNA, 201 bp, Bos taurus; identical to SEQ ID NO: 35053

SEQ ID NO: 116026 - DNA, 201 bp, Bos taurus
atttcacaactttgcatgtgtcatgttttcattgttattctgataaaaacattttcctattttacccaagatttcttgtttaactcactggttatacagaygtgtgctacttaatttctgaacatttggagattttctagttatctttctctcactgagttttaatttagtgaagtcaaagaacatatgttatatgatata

SEQ ID NO: 116027 - DNA, 201 bp, Bos taurus; identical to SEQ ID NO: 35060

SEQ ID NO: 116028 - DNA, 201 bp, Bos taurus
gacataggacacagaagaggttaggaatagcagcaccacctcaggcagcagaagaaaggtagggagagaaataagagcttcctcctcttctgttgctgttycagtgaatttcttcagactcactagaaccatggaatgagtggaaagtcaggagaagaaggcattaaccaagaaaaggatcgaagcccaatggcaggaagt

SEQ ID NO: 116029 - DNA, 201 bp, Bos taurus
cccactgtcttcataggacttcttggtaacctggcctaactgcgtttagaggcattccaatgatactgctcaaaatgatagcttccattttgaaaactatraatattgtagattaatgttctattccatatgaaacaatggaatacagtaaatttgtaagtaaagtattctttgcctctttccagatcagtcactttacaa

SEQ ID NO: 116030 - DNA, 201 bp, Bos taurus
aaccttgactcagtgatacagctttcacacccaacagcaaaatgttcttaactcttaactgagagaatagaaatgtctctccatttagggccaacacacayaggggaaaggacctggcagaaaagcagaagtgtgacctggaactcagctctacccaggttagctggcccccacttgcccacctaagactctggagacttt

SEQ ID NO: 116031 - DNA, 201 bp, Bos taurus
tttgactaatctttgcctgtggataagggtggtatgaggcctattttggtggtgaggaccactccacttgcatcagatcccatagacattgccccagtctrtgtaattctcatcaggccatgacaacagcaccaaaggggctaactagcatttgaattgtgtttggtctaaagtttccaaagactcatcaatgctattagg

SEQ ID NO: 116032 - DNA, 201 bp, Bos taurus; identical to SEQ ID NO: 74590

SEQ ID NO: 116033 - DNA, 201 bp, Bos taurus; identical to SEQ ID NO: 35061

SEQ ID NO: 116034 - DNA, 201 bp, Bos taurus; identical to SEQ ID NO: 35062

SEQ ID NO: 116035 - DNA, 201 bp, Bos taurus
tggggcctggacatgagaatttttttaagttttcccagatgactctacttgaagccaaggctgacagagaaccattgactggatcaaaatgaaactgcccrcttcagttgtggcccagtccagctcatctggttagagttctacatggggttctgaatggcctgtttccctggccttgtcctgcatataatgactagaggg

SEQ ID NO: 116036 - DNA, 201 bp, Bos taurus; identical to SEQ ID NO: 35065

SEQ ID NO: 116037 - DNA, 201 bp, Bos taurus; identical to SEQ ID NO: 35066

SEQ ID NO: 116038 - DNA, 201 bp, Bos taurus; identical to SEQ ID NO: 35067

SEQ ID NO: 116039 - DNA, 201 bp, Bos taurus; identical to SEQ ID NO: 35068

SEQ ID NO: 116040 - DNA, 201 bp, Bos taurus; identical to SEQ ID NO: 35069

SEQ ID NO: 116041 - DNA, 201 bp, Bos taurus; identical to SEQ ID NO: 35071

SEQ ID NO: 116042 - DNA, 201 bp, Bos taurus; identical to SEQ ID NO: 74599

SEQ ID NO: 116043 - DNA, 201 bp, Bos taurus; identical to SEQ ID NO: 35073

SEQ ID NO: 116044 - DNA, 201 bp, Bos taurus; identical to SEQ ID NO: 35074

SEQ ID NO: 116045 - DNA, 201 bp, Bos taurus; identical to SEQ ID NO: 35075

SEQ ID NO: 116046 - DNA, 201 bp, Bos taurus; identical to SEQ ID NO: 35076

SEQ ID NO: 116047 - DNA, 201 bp, Bos taurus; identical to SEQ ID NO: 74604

SEQ ID NO: 116048 - DNA, 201 bp, Bos taurus; identical to SEQ ID NO: 74605

SEQ ID NO: 116049 - DNA, 201 bp, Bos taurus; identical to SEQ ID NO: 35078

SEQ ID NO: 116050 - DNA, 201 bp, Bos taurus; identical to SEQ ID NO: 74606

SEQ ID NO: 116051 - DNA, 201 bp, Bos taurus; identical to SEQ ID NO: 74607

SEQ ID NO: 116052 - DNA, 201 bp, Bos taurus; identical to SEQ ID NO: 35079

SEQ ID NO: 116053 - DNA, 201 bp, Bos taurus; identical to SEQ ID NO: 35080

SEQ ID NO: 116054 - DNA, 201 bp, Bos taurus; identical to SEQ ID NO: 35081

SEQ ID NO: 116055 - DNA, 201 bp, Bos taurus; identical to SEQ ID NO: 35082

SEQ ID NO: 116056 - DNA, 201 bp, Bos taurus; identical to SEQ ID NO: 74608

SEQ ID NO: 116057 - DNA, 201 bp, Bos taurus; identical to SEQ ID NO: 35084

SEQ ID NO: 116058 - DNA, 201 bp, Bos taurus; identical to SEQ ID NO: 35085

SEQ ID NO: 116059 - DNA, 201 bp, Bos taurus; identical to SEQ ID NO: 35086

SEQ ID NO: 116060 - DNA, 201 bp, Bos taurus; identical to SEQ ID NO: 35087

SEQ ID NO: 116061 - DNA, 201 bp, Bos taurus; identical to SEQ ID NO: 35088

SEQ ID NO: 116062 - DNA, 201 bp, Bos taurus; identical to SEQ ID NO: 35089

SEQ ID NO: 116063 - DNA, 201 bp, Bos taurus; identical to SEQ ID NO: 35090

SEQ ID NO: 116064 - DNA, 201 bp, Bos taurus; identical to SEQ ID NO: 35091

SEQ ID NO: 116065 - DNA, 201 bp, Bos taurus; identical to SEQ ID NO: 35092

SEQ ID NO: 116066 - DNA, 201 bp, Bos taurus; identical to SEQ ID NO: 35093

SEQ ID NO: 116067 - DNA, 201 bp, Bos taurus; identical to SEQ ID NO: 35094

SEQ ID NO: 116068 - DNA, 201 bp, Bos taurus; identical to SEQ ID NO: 35095

SEQ ID NO: 116069 - DNA, 201 bp, Bos taurus; identical to SEQ ID NO: 35096

SEQ ID NO: 116070 - DNA, 201 bp, Bos taurus; identical to SEQ ID NO: 35097

SEQ ID NO: 116071 - DNA, 201 bp, Bos taurus; identical to SEQ ID NO: 35098

SEQ ID NO: 116072 - DNA, 201 bp, Bos taurus; identical to SEQ ID NO: 35099

SEQ ID NO: 116073 - DNA, 201 bp, Bos taurus; identical to SEQ ID NO: 35100

SEQ ID NO: 116074 - DNA, 201 bp, Bos taurus; identical to SEQ ID NO: 35101

SEQ ID NO: 116075 - DNA, 201 bp, Bos taurus; identical to SEQ ID NO: 74610

SEQ ID NO: 116076 - DNA, 201 bp, Bos taurus; identical to SEQ ID NO: 74612

SEQ ID NO: 116077 - DNA, 201 bp, Bos taurus; identical to SEQ ID NO: 74613

SEQ ID NO: 116078 - DNA, 201 bp, Bos taurus; identical to SEQ ID NO: 35103

SEQ ID NO: 116079 - DNA, 201 bp, Bos taurus; identical to SEQ ID NO: 35104

SEQ ID NO: 116080 - DNA, 201 bp, Bos taurus; identical to SEQ ID NO: 74614

SEQ ID NO: 116081 - DNA, 201 bp, Bos taurus; identical to SEQ ID NO: 74615

SEQ ID NO: 116082 - DNA, 201 bp, Bos taurus; identical to SEQ ID NO: 74617

SEQ ID NO: 116083 - DNA, 201 bp, Bos taurus; identical to SEQ ID NO: 35106

SEQ ID NO: 116084 - DNA, 201 bp, Bos taurus; identical to SEQ ID NO: 35107

SEQ ID NO: 116085 - DNA, 201 bp, Bos taurus; identical to SEQ ID NO: 35108

SEQ ID NO: 116086 - DNA, 201 bp, Bos taurus; identical to SEQ ID NO: 35109

SEQ ID NO: 116087 - DNA, 201 bp, Bos taurus; identical to SEQ ID NO: 35110

SEQ ID NO: 116088 - DNA, 201 bp, Bos taurus; identical to SEQ ID NO: 35111

SEQ ID NO: 116089 - DNA, 201 bp, Bos taurus; identical to SEQ ID NO: 35112

SEQ ID NO: 116090 - DNA, 201 bp, Bos taurus; identical to SEQ ID NO: 35113

SEQ ID NO: 116091 - DNA, 201 bp, Bos taurus; identical to SEQ ID NO: 35114

SEQ ID NO: 116092 - DNA, 201 bp, Bos taurus; identical to SEQ ID NO: 35115

SEQ ID NO: 116093 - DNA, 201 bp, Bos taurus; identical to SEQ ID NO: 35116

SEQ ID NO: 116094 - DNA, 201 bp, Bos taurus; identical to SEQ ID NO: 35117

SEQ ID NO: 116095 - DNA, 201 bp, Bos taurus; identical to SEQ ID NO: 35118

SEQ ID NO: 116096 - DNA, 201 bp, Bos taurus; identical to SEQ ID NO: 35119

SEQ ID NO: 116097 - DNA, 201 bp, Bos taurus; identical to SEQ ID NO: 35120

SEQ ID NO: 116098 - DNA, 201 bp, Bos taurus
ctgaattaaatataaaaattgctgaaaaatgaagcaaagactggcccggcgctctcctaacatctcatctttttccaagcctagcttgcctgccttgctarattccactttgcaggcaggccatgcgacttaggttctggccaatagaatgtaaaggcccttccaagtgtgagcctaatcctgcccatcctctaggctctc

SEQ ID NO: 116099 - DNA, 201 bp, Bos taurus
cagagaggcagaagggcagggcaagtggtacccagtgacactcaggcaagcgagtgaactaagcaagacgtggggcacggttggactgtttccttcactcrggccaaatcatttaatgatgttcacaggagccagagagggaggggttgttattccagtcttccatttcaaaaacaggggctcagagagatgaatcacttg

SEQ ID NO: 116100 - DNA, 201 bp, Bos taurus
aattttaaaatgctgtcccttaattgcactagtcacattttaagtgttcagtagtcgtatgtggctagtggctaccaaggaattatagaacatggccatcmttgtgcaaattctactgggcatgctgtgactggcacagtagagactgctgtgaggggcacaatagaggctgggtagggtaatgtaggtaaaacaggccag

SEQ ID NO: 116101 - DNA, 201 bp, Bos taurus; identical to SEQ ID NO: 35122

SEQ ID NO: 116102 - DNA, 201 bp, Bos taurus; identical to SEQ ID NO: 35123

SEQ ID NO: 116103 - DNA, 201 bp, Bos taurus; identical to SEQ ID NO: 35124

SEQ ID NO: 116104 - DNA, 201 bp, Bos taurus; identical to SEQ ID NO: 35125

SEQ ID NO: 116105 - DNA, 201 bp, Bos taurus; identical to SEQ ID NO: 35126

SEQ ID NO: 116106 - DNA, 201 bp, Bos taurus; identical to SEQ ID NO: 35127

SEQ ID NO: 116107 - DNA, 201 bp, Bos taurus; identical to SEQ ID NO: 35128

SEQ ID NO: 116108 - DNA, 201 bp, Bos taurus; identical to SEQ ID NO: 35129

SEQ ID NO: 116109 - DNA, 201 bp, Bos taurus; identical to SEQ ID NO: 35130

SEQ ID NO: 116110 - DNA, 201 bp, Bos taurus; identical to SEQ ID NO: 35131

SEQ ID NO: 116111 - DNA, 201 bp, Bos taurus; identical to SEQ ID NO: 35132

SEQ ID NO: 116112 - DNA, 201 bp, Bos taurus; identical to SEQ ID NO: 74639

SEQ ID NO: 116113 - DNA, 201 bp, Bos taurus; identical to SEQ ID NO: 35133

SEQ ID NO: 116114 - DNA, 201 bp, Bos taurus; identical to SEQ ID NO: 35134

SEQ ID NO: 116115 - DNA, 201 bp, Bos taurus; identical to SEQ ID NO: 35135

SEQ ID NO: 116116 - DNA, 201 bp, Bos taurus
cacccatgaagtcatctgaaatcctgtcttgtgtttccttcttgtcctttgccctttatttcactggaggaaggctttagggaaatagtaagaatgctgcrgtaacagagggaattaatttgaccctgctctgaagaaacagtgtgttgattcccactagcaatagtttctccacccttcagaacagggcaagggatgtgg

SEQ ID NO: 116117 - DNA, 201 bp, Bos taurus; identical to SEQ ID NO: 74644

SEQ ID NO: 116118 - DNA, 201 bp, Bos taurus
aatgagaatgtcaaaggattttagaacaaccacagcagcactggaggcccacaccagtgcagaagcacttggagttgggggcccttcgccaagtcagggcrtatgttcttgctgctcaggctactcagcggtgataagtaatcaaggagaagcaatattcagtgtctctgacattcctgcagagaggaatataggccaggc

SEQ ID NO: 116119 - DNA, 201 bp, Bos taurus
ttcattcacttaacatgtattccattccttctgctggttttgtctcatatgctccatatatacagtctccttgatttttaaaccacatttctgtaagcgtycataggtggatattctcccattttagagagggaaaactgaggctcagagaccttaactgaggacatccaacttgtaagaggcagaggcaagattcaagtc

SEQ ID NO: 116120 - DNA, 201 bp, Bos taurus
ttccatggagacactgaagtaaagggtcaagtcttggggacaggaagcttccccaggccatagggaacctcccctcacctttacagccagagcctacactycaggatctctgggaatcaatgcttccatctttggtatcacccagggactgactccggtggaggaaattctgggctggccaatgggtgtgctcagccccca

SEQ ID NO: 116121 - DNA, 201 bp, Bos taurus
gcaaccaccccccaaccgcccccactgggcatagtcattctgaccctttggaggtttcatctgaaacctccatctcccctcctctgcagacgaaattttakggttaggggttctggtcagcacctgtggcagcctccccagagctgacgttttacaagtttaggcctctgaagctggggtggttgagccaaagcctcaagc

SEQ ID NO: 116122 - DNA, 201 bp, Bos taurus; identical to SEQ ID NO: 35137

SEQ ID NO: 116123 - DNA, 201 bp, Bos taurus; identical to SEQ ID NO: 74648

SEQ ID NO: 116124 - DNA, 201 bp, Bos taurus
gactggctcagcctttgatcaatgaggaaggacacacctccaccccaggattctgtttgcctgtgcttatctgggctctagtcttaagcagtttccaagaraagggccacatcaggctttttatgaaagctatccttcttgattatttttctcttctgttctcccactcattcgcaatgaaccaggatccctgaccttttc

SEQ ID NO: 116125 - DNA, 201 bp, Bos taurus
ctatctctaggcccttagtttcctcatctgtcagatgagacttgaactacgggatctctgaggtcgctctcagctcaaaccacctttgaccctgttgatcrttcctgccagagtgaggtggccccaagccaggactcatgatctgatggtgctggcattaaaaagaataaggccagagggtgaggcatacaaaaaccagac

SEQ ID NO: 116126 - DNA, 201 bp, Bos taurus; identical to SEQ ID NO: 35139

SEQ ID NO: 116127 - DNA, 201 bp, Bos taurus
tgaatgcttctggtgaaagtcacaaaatgtgctgattcgttctactaaaaatacgttaacctccccacacctcccatagctgttacattttcctgccatcytcagtgcccttgtatctactcttccctttctccaagatggtaaccaattttacctatttaatggattgagatcatctaacacaaactctctgcatcttct

SEQ ID NO: 116128 - DNA, 201 bp, Bos taurus; identical to SEQ ID NO: 35140

SEQ ID NO: 116129 - DNA, 201 bp, Bos taurus
agggccccttgggccccacttacctatctgtggcctctttggactccagctaattagcagccacaggaaggcctgtggagggggtactcaggcctgccacygcagagccctgccattagagcgatcgataccatggttgaggggggaagcagctaagaggagggggcctggaaaggctcctgagctgcataaataactcat

SEQ ID NO: 116130 - DNA, 201 bp, Bos taurus
ttgctggccagtggtaagggccctggctgtcttaaaggatgagagtcatatctaagaggaagttgtatgcctatgcttccctttctccaggtttctcctcrtggggccttgtgttgagggatgccttggtgttcacttcctccgtatccccagcaggtggcagcatgctctgagctgggctgcaaaaccggtgggaaagtg

SEQ ID NO: 116131 - DNA, 201 bp, Bos taurus
ggctggattaagcctctggagcagacgttgcctgtggctcgccagcattccgagagctagacgggcggcgggcatggatggggattcagctagctcacaamactgttgagtaaagacctggagagtctgttctgaaaggagaggccaaggaagggtcaggtgtcaggggactccaggcgagccccgctcagtgccttcaga

SEQ ID NO: 116132 - DNA, 201 bp, Bos taurus; identical to SEQ ID NO: 35142

SEQ ID NO: 116133 - DNA, 201 bp, Bos taurus; identical to SEQ ID NO: 35144

SEQ ID NO: 116134 - DNA, 201 bp, Bos taurus; identical to SEQ ID NO: 35145

SEQ ID NO: 116135 - DNA, 201 bp, Bos taurus; identical to SEQ ID NO: 35148

SEQ ID NO: 116136 - DNA, 201 bp, Bos taurus
tggaaaaccttagcatgaagtacaagtccttcaagatctggcccctagaacttctctaaactcatctctctgaactttaccctcagtctttagtcatttgraagagctcttgtccactttaggcctttgcatactgatcccttcagggcttccctgaccactcagcaataaagaatctgcctgcaatgcaggagactgatg

SEQ ID NO: 116137 - DNA, 201 bp, Bos taurus; identical to SEQ ID NO: 35152

SEQ ID NO: 116138 - DNA, 201 bp, Bos taurus
cattttctctcccagttatcacccaaccttaatgaggatgataaagaaaaggtgacaagaacaaagaaccctatgaggcaggaatgctagataagcagtcygggagaagataaaaattcccttcacataggctgcctgtaatattggaatctccttaccttcactacccagtaactatttcagtcttactcatctttcaag

SEQ ID NO: 116139 - DNA, 201 bp, Bos taurus; identical to SEQ ID NO: 74658

SEQ ID NO: 116140 - DNA, 201 bp, Bos taurus; identical to SEQ ID NO: 35155

SEQ ID NO: 116141 - DNA, 201 bp, Bos taurus; identical to SEQ ID NO: 35157

SEQ ID NO: 116142 - DNA, 201 bp, Bos taurus; identical to SEQ ID NO: 35161

SEQ ID NO: 116143 - DNA, 201 bp, Bos taurus; identical to SEQ ID NO: 35162

SEQ ID NO: 116144 - DNA, 201 bp, Bos taurus; identical to SEQ ID NO: 35164

SEQ ID NO: 116145 - DNA, 201 bp, Bos taurus; identical to SEQ ID NO: 74668

SEQ ID NO: 116146 - DNA, 201 bp, Bos taurus
gtatctgaagaaatttacatcatcagtttccctcgccacctccctttctcagtcaaatgctatggctcaaattcaaattccaattaatgtggccaaggttrgagaacaaactttatgttcaagctttattatcactggatgagcacccaccaacaccacagtgtttggttctttaaatccagatgacatgtgttcaagcta

SEQ ID NO: 116147 - DNA, 201 bp, Bos taurus
agaacccacctaccaactcaggagatgtaagagatgcgggtagaagagactagaaggcattttggaataatgggcatacactgtgaaaatggcctcctctyttgtgaccacacctgaagaagtgacacccagtttgcctcttatctgtgggtctagaggtccaaatggacccttggcaattggaggtcattggaacatctc

SEQ ID NO: 116148 - DNA, 201 bp, Bos taurus
ctgctgaggccttcctgtgtggtctgcctccagtctccagccagtggccaagaccttgacacctcaaagtctcctggggctggactcttgacatccccacygtgtgtgcatctcccagaaagggccagcatcatctggaggttggggggcggcatggaggggtgggctccacctccaaggattgacaagagcagccagaga

SEQ ID NO: 116149 - DNA, 201 bp, Bos taurus; identical to SEQ ID NO: 35168

SEQ ID NO: 116150 - DNA, 201 bp, Bos taurus; identical to SEQ ID NO: 35169

SEQ ID NO: 116151 - DNA, 201 bp, Bos taurus; identical to SEQ ID NO: 35171

SEQ ID NO: 116152 - DNA, 201 bp, Bos taurus; identical to SEQ ID NO: 74678

SEQ ID NO: 116153 - DNA, 201 bp, Bos taurus; identical to SEQ ID NO: 35173

SEQ ID NO: 116154 - DNA, 201 bp, Bos taurus
ttagagaactgaaacagtttaatcatccgttatagagttccaggaaacagcctcctgtgcagccactgcacaacttatcatatctggccaagaacagtcgmggtgttaggcatcagcaggtgaagaagaatgaaagggttaaatccaaacatctgagacggtgtcctgaactggcctcccaaagatggttctcagaggaca

SEQ ID NO: 116155 - DNA, 201 bp, Bos taurus; identical to SEQ ID NO: 74682

SEQ ID NO: 116156 - DNA, 201 bp, Bos taurus
ttagactaaatatagtcatcaagtcacaagggaagaaagaaacaaagaagaaacagaaaagaactacaaagacaaccagaatatggccaaaaaaatggcawtaagtacacacctatcattacttcatttttgttttcctggcagcactatgagatttgcaggaccttactttccttatcacggatcaaacccggggccaca

SEQ ID NO: 116157 - DNA, 201 bp, Bos taurus; identical to SEQ ID NO: 35177

SEQ ID NO: 116158 - DNA, 201 bp, Bos taurus; identical to SEQ ID NO: 35178

SEQ ID NO: 116159 - DNA, 201 bp, Bos taurus
agaaaaatgtcagacttgccaagatgtggggaaagagggtttggggttcaaaaaaaaaaaaagaacaagtgcaaaggccttgaggcagggacctgaggccrgaacaaatgattcttggagaggtagaaagagggtcaatgtggttagaggacagtagcagagaaatccttagagaggcaggctggggccatgatgagagca

SEQ ID NO: 116160 - DNA, 201 bp, Bos taurus; identical to SEQ ID NO: 74686

SEQ ID NO: 116161 - DNA, 201 bp, Bos taurus; identical to SEQ ID NO: 74687

SEQ ID NO: 116162 - DNA, 201 bp, Bos taurus; identical to SEQ ID NO: 74688

SEQ ID NO: 116163 - DNA, 201 bp, Bos taurus; identical to SEQ ID NO: 74689

SEQ ID NO: 116164 - DNA, 201 bp, Bos taurus; identical to SEQ ID NO: 74690

SEQ ID NO: 116165 - DNA, 201 bp, Bos taurus; identical to SEQ ID NO: 74691

SEQ ID NO: 116166 - DNA, 201 bp, Bos taurus; identical to SEQ ID NO: 74692

SEQ ID NO: 116167 - DNA, 201 bp, Bos taurus; identical to SEQ ID NO: 35180

SEQ ID NO: 116168 - DNA, 201 bp, Bos taurus; identical to SEQ ID NO: 74693

SEQ ID NO: 116169 - DNA, 201 bp, Bos taurus; identical to SEQ ID NO: 35181

SEQ ID NO: 116170 - DNA, 201 bp, Bos taurus; identical to SEQ ID NO: 35182

SEQ ID NO: 116171 - DNA, 201 bp, Bos taurus; identical to SEQ ID NO: 35184

SEQ ID NO: 116172 - DNA, 201 bp, Bos taurus; identical to SEQ ID NO: 74694

SEQ ID NO: 116173 - DNA, 201 bp, Bos taurus; identical to SEQ ID NO: 35185

SEQ ID NO: 116174 - DNA, 201 bp, Bos taurus; identical to SEQ ID NO: 35186

SEQ ID NO: 116175 - DNA, 201 bp, Bos taurus; identical to SEQ ID NO: 35187

SEQ ID NO: 116176 - DNA, 201 bp, Bos taurus; identical to SEQ ID NO: 35188

SEQ ID NO: 116177 - DNA, 201 bp, Bos taurus; identical to SEQ ID NO: 35189

SEQ ID NO: 116178 - DNA, 201 bp, Bos taurus
gcacatacaagtcagatgtttcataaaaggtttagatgacctgataatatgttttcaaaacccagagagtgagtgagagaaagagagagagagaccctgaygcaacctcaagttaaaaacaaggaaagaaaagtacttttgtagattggaatcgataaggagtaaggaggatacctattcgctctgttctaattttaacct

SEQ ID NO: 116179 - DNA, 201 bp, Bos taurus; identical to SEQ ID NO: 35191

SEQ ID NO: 116180 - DNA, 201 bp, Bos taurus; identical to SEQ ID NO: 74698

SEQ ID NO: 116181 - DNA, 201 bp, Bos taurus; identical to SEQ ID NO: 74699

SEQ ID NO: 116182 - DNA, 201 bp, Bos taurus; identical to SEQ ID NO: 35192

SEQ ID NO: 116183 - DNA, 201 bp, Bos taurus; identical to SEQ ID NO: 35193

SEQ ID NO: 116184 - DNA, 201 bp, Bos taurus
tctttcagaacaaaagccaaaatcctaacagtggcctccgaggccgatgtaaatgcttggtacgtcactgacttcacctcctaccactcacagctcttcastccagctcccctggcctccctgctgttcctctcccacctcaggtccttgctggaatgttcttcccctagacacccacaccattcactccctccttccctt

SEQ ID NO: 116185 - DNA, 201 bp, Bos taurus
taccatcctccagttaaacttttttttttctttactagttgtttctttataaagttcttagattactgaaaacaaacttgtgtaatgatttttactatacrtaagtcattcgaacctgcctaaaatttaatattctagcaaggttttcctttttggatcagaatgacaggaagcctcaagctctttggaaaggtcagtgct

SEQ ID NO: 116186 - DNA, 201 bp, Bos taurus; identical to SEQ ID NO: 74708

SEQ ID NO: 116187 - DNA, 201 bp, Bos taurus; identical to SEQ ID NO: 35201

SEQ ID NO: 116188 - DNA, 201 bp, Bos taurus; identical to SEQ ID NO: 35203

SEQ ID NO: 116189 - DNA, 201 bp, Bos taurus
gtggtcagctgccacagggccctgcatgctggtggacggccacctcgggattacccctgcaattttccattcccttccatatttcttgacatctcagtgckcatgggagttaccttggcctcctgactggctcttcagtggttgggccgcaccctacaggccaacaaaccttgtagttgcccagcctggggactgaagaca

SEQ ID NO: 116190 - DNA, 201 bp, Bos taurus; identical to SEQ ID NO: 35204

SEQ ID NO: 116191 - DNA, 201 bp, Bos taurus
cagggaccaagaccagggtagaggccaacagatagagaccgtgtaaaacaagaggtgctgacgaatggtcaggctccttgtttgtacaggacagacatgtrggggcaaggggttaggaggaggccacatattatctgagtccgtttatatataggaaatgtccacaatagggaatccattcagacagaaaacagatttgag

SEQ ID NO: 116192 - DNA, 201 bp, Bos taurus
ttcctcgtctgtaaaatgggattcgtgttggtaattgtgaggatgaagtcaacgtaactcttgcctgtaaaggatgggaacagggcctggcacatagcatrcgtgcaaagcctgccctgttaactatcagatctttgctattgaacccttgctctggctgccgtgtgggggccttgcaggatgacttgagaaggatcagag

SEQ ID NO: 116193 - DNA, 201 bp, Bos taurus
taaaatgccgcctcctcagagaagccttttctgactactgtgtccggatactgttctattctgccatctgtgccctggcccttctctttcttcatagttcrgttcagttcagttcagtcactcagttgtgtccgactctctgtgaccccatggcctgcagcactccaggcctccctgtccatcatcaactcccggagcttg

SEQ ID NO: 116194 - DNA, 201 bp, Bos taurus
ctgctcaggcccggggctggagaagtggtcagaggaggtgatggggcttcacaagggaggcaaggtcccctggacattgcaggtatctcttgctttcagcragatcaattaggggccatcatgtgcatcacgaaaggaaactacctttgataaaagaaaattttaaaaaagaagaaagagtaaccgtagggtttctctgag

SEQ ID NO: 116195 - DNA, 201 bp, Bos taurus
tcctttcaaacaatgtaacttcagatctgaaaattcctgacgagtggaaaacaatactactttaatttccatttcaccaagatatctgaaacacagggagrggttaacttacccacaaccactgagcaaccaggccaagatgacaggcggtgatcctaatccctggctaaattctctttctgctgaatcgtaacccaggtg

SEQ ID NO: 116196 - DNA, 201 bp, Bos taurus
ctgggtccaatgaccggtctgggtggctgtgctttccggcacttcccaggaagaggacccattttgccaagctgttttaggggctggagagagaggccttyaccaacgaataagctcagtacaagagctgtttactgaagcaccttccaaagaggacgggctggtcctgcaggtgttcattgttagagaggggtcagcagc

SEQ ID NO: 116197 - DNA, 201 bp, Bos taurus; identical to SEQ ID NO: 35207

SEQ ID NO: 116198 - DNA, 201 bp, Bos taurus; identical to SEQ ID NO: 35208

SEQ ID NO: 116199 - DNA, 201 bp, Bos taurus
gtagcggccccgcagggagctcctggagcctcgctccacgtctccagctgggacggggtctgcgtgagcaaagggcagagtgtttggctatgaattcagaraacaaaaaggcctacctgaaggcaagaagatgaaccaggtaacaagctggtggctttccccccacggggcatttggaaatgtctagtggcctccaactag

SEQ ID NO: 116200 - DNA, 201 bp, Bos taurus
gcaacatggggaacatagcaaatattttataataactataaatggagtataacatttaaaaattatgaatcattatattgtatacctgtaatctgtgtatyatacatcaactatacttcaattaaaaaaagtaagaaaataatccctaagcagatttgcaaactgtatttcatagaaatttcatctgagagaaaaaagtcc

SEQ ID NO: 116201 - DNA, 201 bp, Bos taurus
gtgccagtccccctttggtcacttactcacccattaggctagaaaaatacctgcttctaggtgccacccacctggcaggtgagacctttcaatccccaagrctcctcctgcagtccaggccctgctgctgggtaactggctggacgatggacaagtacccacccccccaaatacacacccacacacatatgcatgacgctg

SEQ ID NO: 116202 - DNA, 201 bp, Bos taurus
caatgtacaaagtaaggaatacaaaagggagcagacattttgtcttcaatggccattagtgctaactactcagaacttaggcttcaaaaaatatagcaagyatctaaaacctgcttacaaggcctcctggtggctcagatggcaaagaacctgcctacaatgtgcgagacccaggttcaatctctggaagatcctctagaa

SEQ ID NO: 116203 - DNA, 201 bp, Bos taurus
tacagaatcaaagactgacaattaccttttgttcctctctttcggttgcatggtgacacttttcaattctccaatgcctcaagaaatctcgaagatatccraagagagtgaggacaccataccccacataagtaagcacagcaaccagcattggtgtttcttcaaaaccttcattaaagggtcttttatacagtcctccat

SEQ ID NO: 116204 - DNA, 201 bp, Bos taurus
cctcaaaaacattaaacataccatatgatccaacagtttcacatctacgtacatacctgaaagaactgaaagcatagtttaagagttattggctgacagcrgcattattcacaacaactgcaacatggaagcaactggagtgtacactgacaggtgtatggctatgcaaaatgtggtatatatacatacaacggaatatta

SEQ ID NO: 116205 - DNA, 201 bp, Bos taurus; identical to SEQ ID NO: 35210

SEQ ID NO: 116206 - DNA, 201 bp, Bos taurus; identical to SEQ ID NO: 35211

SEQ ID NO: 116207 - DNA, 201 bp, Bos taurus
cgtactctcggtctctgcggttttcctttgactgttgaatcatagttagttgcatcacttcactggtctccccagtcctaactctgtctctctctgtaacrgaaggccttgcgactcaaagttgaatctgtattcttgtgaaatgcagactctgattcagcaggtctggtggggcctgagaccctgcaggtgcaacaagcc

SEQ ID NO: 116208 - DNA, 201 bp, Bos taurus; identical to SEQ ID NO: 35213

SEQ ID NO: 116209 - DNA, 201 bp, Bos taurus
ccccgtcagagctggtgtcggccagtgccacagcagagcccccctaactgcatcaaactgcgagtcactaaccgctttgggcctcggtccccttttgttgytgtttagtggctcagtcgtgcccgactctttgcgaccccacggactgcagcacaccaggcctccctgtccttctctgcctcccagagcctgctcaaactc

SEQ ID NO: 116210 - DNA, 201 bp, Bos taurus
tgcaaatacttgatgtgaaaaatgagcaacagcacccccttccctccattcaataaaagtaaagcctcttttacagagtgcacgaacagtatttgcacttygctcatgcggtctccgtggggtcgtgtgtgtcatttggcttcatgacagaggctcataaagtgtcagtgctactcattcgtcaccagatattactgacca

SEQ ID NO: 116211 - DNA, 201 bp, Bos taurus; identical to SEQ ID NO: 35214

SEQ ID NO: 116212 - DNA, 201 bp, Bos taurus; identical to SEQ ID NO: 35215

SEQ ID NO: 116213 - DNA, 201 bp, Bos taurus; identical to SEQ ID NO: 35216

SEQ ID NO: 116214 - DNA, 201 bp, Bos taurus; identical to SEQ ID NO: 35217

SEQ ID NO: 116215 - DNA, 201 bp, Bos taurus; identical to SEQ ID NO: 35218

SEQ ID NO: 116216 - DNA, 201 bp, Bos taurus
gacataatccccattttacgggtaagggtggagtcagtatgtgagagaatcaggcatgtttgaccttcaagtagagttcctagtgtaataagtggtggacktagctctttcattaaacttttgatagatttaggataaaggtagtcaagaaaattgctcatggaattagtgtgaattgaattcatgagaatcacagaatcc

SEQ ID NO: 116217 - DNA, 201 bp, Bos taurus; identical to SEQ ID NO: 35219

SEQ ID NO: 116218 - DNA, 201 bp, Bos taurus
ctgtgcactttgcagggagtctagcttgttttgaaattagcctagcttgcctgcatctgggaaggactctggcagagaaggccctgcatgcaggagctgaragggagcatttcttacctccagacccacaggacacaggttatccctgccccccaccgggaagtgaggcagaaatgactcttggccatcagccacagtttt

SEQ ID NO: 116219 - DNA, 201 bp, Bos taurus
agagtccaattactttaataaaaagagcatctgaattagaacctggccaccaggtccatttctggtactgattagaaagccgtaactcctctgtggacacycatgtcttgatctgtcaaatgaggattgttatcactgtcacaccaaacataccctaccaaggagcccttctaacgtagaaagacaaattggatagcaaca

SEQ ID NO: 116220 - DNA, 201 bp, Bos taurus; identical to SEQ ID NO: 35222

SEQ ID NO: 116221 - DNA, 201 bp, Bos taurus
taagggatcagatttaggtcactgctccttagacttgactctgcacaccaggcatgtgggcatcttgtggaaatgcagatactgattcaggaggtctggcrtgaggcctgaggttctatattcctaacgggctccccagggatgctgatgttgctggtgggtggatatatgttgagctgtgaagttttagtgatattagag

SEQ ID NO: 116222 - DNA, 201 bp, Bos taurus
attaaattggcttctctttctctctcttctctagatgctttgtttggtgtctctaaagtttgctggcaagtggttgctctggagattaaattgttcttgaraggccagtgtaggaggattatactatcctagtgtatatttctttaggacttttaatataaatctttgtcggagtgggcgatggaggtgagggctgccata

SEQ ID NO: 116223 - DNA, 201 bp, Bos taurus
ttttgtctatatgagggcatggaaatgagatttctctgtatcatcctggcctataaatatgcattgaaaatacatggaaccatggccccacacttatgcamagagtatgtgggttgtttgtcttcctgacctctccacagacttgcctagaacaaaaggactgtctggcccctgcctggctggaatttacctatagaacag

SEQ ID NO: 116224 - DNA, 201 bp, Bos taurus
tcagggagtgttattaaatgataagggggcttgctttctggttgtatattgtgggaggctgagaaacaatgagcgttgtgacactttagaggccgtgtgcrtgctgattaggggaaccccgtatgggagagcaggtcacgtggcagggctgcctctgagatgccgccgcccttccctggagggttattaatgggccttcac

SEQ ID NO: 116225 - DNA, 201 bp, Bos taurus
tttgtgtttctactgtttctaatacctttggcaaatagcccagtacaacaacaccataatgatagtgagggtgccttagctttgttcctgaccttagtagragtgattctggtgtttccttaataaccatgaggctgacttttggaaatatacccatccttatagttatctaacattgaaccatccagtttttggtttctc

SEQ ID NO: 116226 - DNA, 201 bp, Bos taurus
actcacagccttgtccaactctctgcagccccatggactgtagcccgccaagctcccctgtccatgggattatctaggcaagaatactggagtttgattcrtccctctgggagtagacatctgatcacaggccctttctgccctgcgccagaggagatgagacctgtgtgtcgtggatgcttggtcttaggtgccctgtgt

SEQ ID NO: 116227 - DNA, 201 bp, Bos taurus
ctctagagcccatattctattattttactctcctgctttaaactgaatctacttggattttaatcctttattaaaatggaggccttgaaaacttttatgcrggccagcgagtggcaatggtgtattaggtggctcactaaggtcttgagaacaccgagtccctggttagcaacccagagcaaaaaaaaaaatgtattttca

SEQ ID NO: 116228 - DNA, 201 bp, Bos taurus
tttgtttttgaggaaccctgagtgataaagatattggcacgaggcatagtcccaatcaaacatagtccattagagttaatttggtcattttgtaggctgcrgtgagtgttgaactgtttgttaatgtgaaatggatagttagtgatccatgataagaactggcatatgactaatcaaggcattgctggtgactgatggtga

SEQ ID NO: 116229 - DNA, 201 bp, Bos taurus
cttcccaagccaccggactctatccagcaccatgaggggctacgggcatacgaatgtgggaactgcagcacacatctgagtcttgctgccccacagacagygactcttcagccacctcttgaacctagagggattcacactgtctttgagaagacaagaccgaaggagagggcctgaactttttctctgagtgggctcttc

SEQ ID NO: 116230 - DNA, 201 bp, Bos taurus
gtcatctttgtttgcacaatattactatgcactcagtagctgcccaataaatattaattgataacgatggaaaagggctttataaacagatggtctagtayaaatttgctgaaaatgtgaataaaaacattccactcttcaagaaaagcataaagtagaaattaaacaagtcctgcactcagaaaacctcagtctattatc

SEQ ID NO: 116231 - DNA, 201 bp, Bos taurus
tagggaattctctggtggcccaatgtttaagacttcacactctcactgcctagggaccaagttcaatttctcctccgggaattaaacccccctcccccccmccagccatatggcatggccaaaatcgaacaaacaaataagaatattcattttatcccagaattctggggtatctttccggcttccatccccatgtgaatt

SEQ ID NO: 116232 - DNA, 201 bp, Bos taurus
ttggccttttgactaagagcaaatgcatttctcccatcattctgacactgcagacctttcttttttcactcaagttttttttcctctgcatatgaacttgytcaggcctcctctgtcttggtacttcgcaccctccggagatagcattctgtctattcttctgtgcagtactactcccctccccttcctgcgtctgtgagt

SEQ ID NO: 116233 - DNA, 201 bp, Bos taurus
cttatagtccactctactgttatgagtcaagggctttgttcatcagttctcgttgacactgcacactgccttcctgggagagtggctggcctggatttcayagcaagtgagcttgtattccatcctgcaaagttctcttcataccagaccacacatatggctcaaggagagctatttactctctttttagagtccgagaaa

SEQ ID NO: 116234 - DNA, 201 bp, Bos taurus
caaagaattcagtagtcctaataaacttatgaatatattacgttgcccttctgttaacagattatgatgttatacaaggcacaccagtttactgcaaattmgaaggcaatgtctgaagtttattttctgcctttgaatctcttaattcttgtttttttggggagaaaattatttgcttttcatcgagtattatttttgttg

SEQ ID NO: 116235 - DNA, 201 bp, Bos taurus
ggcaggactccagactaggtccatgaagtaaacgagggtcttaattaaatccaaagctattcacaccatgagggttttcacttagtttttttctgacatgktttcaggaaaggtgtcagtttatatttgattgattcagaaagagctgaaaagccatatcccgattttgccttcactgcaaatgaatgatgcctagaatag

SEQ ID NO: 116236 - DNA, 201 bp, Bos taurus
attacacacataagtgatatcatacagtattagtctttttctgacttaatttcactttgcaaaattaccttccaagtccatttgtggttgcaaatggcaamatttccttcatttttatgactgagtagtattccattatacttcacaccttattttcttcacctgtctgttgatggacacttaatttgcctctgtatcttg

SEQ ID NO: 116237 - DNA, 201 bp, Bos taurus
actctcaaaatgggtcatttaatttccatttaagaactgtcaagactaaccagagctgcagacagtgcacctccatggccaacaggtgggtaatggcagcytcaggggcaggtggtgacgtctaagttatacagactgagaaatccagttagtgttattcactcagttctgtccgactctttgtgaccccatggactgtgg

SEQ ID NO: 116238 - DNA, 201 bp, Bos taurus
cgagctccccaagggcaggaatcccctcctttcagcccatctgttaggacctgctcaaaagcccaccaggccccaggattagcaggccttacagactggaygatgcaatagacgtctctggacattcctggaaaacaaggacgagctgcctggggattatatttgggcaaggaaggaagcagaaaacagcgggcctgagag

SEQ ID NO: 116239 - DNA, 201 bp, Bos taurus
ttctggcctggagaatccttgcaaagagttggacaagactgaatgactttcactttcaatgaaagagaaaaagatgtagtttgtttaaaagtatgttctaytgtcctttaatgttgaggagactaatgctcaagaggaatatgagttatcactgatatttgtagctgggtaaagaatttctaaaataagttaactcatttc

SEQ ID NO: 116240 - DNA, 201 bp, Bos taurus
tccaactcctggagtgggctcgctgggtgccaccacctgcttccagccaggccagctaaagtcatgcctttagggtctgaacggaccccactaaatgcccrgaggtgaatatgttaaaatggaggccaaaacgttaaaagtttgcattgctctcttctccaagaggagagggggtggggctgaaatcggatcccagggcta

SEQ ID NO: 116241 - DNA, 201 bp, Bos taurus
tactttggccacctggtgtgaagagcggagaattggaaaagaccctgatgtatatgggcattaaggaaggttcaggaaagtggtaggggctatttgcctcygctggatggaaaaatattagttcagatataaaggactcagaccgagagtcacctcaggacacattctgaagcagtctgttgcagcacacttccagacagc

SEQ ID NO: 116242 - DNA, 201 bp, Bos taurus
ttacctccaatcttaaaggacaaggaaagtcagcaagctgagagatttgggagagtctaaggctgacagctgggttatgtatgacactaatgtgcagtgcrtagtcttgactctttgctcaagcatacctagaagagaagagcgatgctagcaaataagactctgaaaatagcctccgagagctttattaattacctctct

SEQ ID NO: 116243 - DNA, 201 bp, Bos taurus
gaaatggagaacagaatgggttcagagttcctggaaatgaactactgcttatagccatatccagactggagcccatgttcttgtgtctcccaggcccttgktctttcttatgtatcatgttgactttcatttttgaccgaagaattttagtagcaaccatggattttattatcgcggctacatagctgctgaactaggccc

SEQ ID NO: 116244 - DNA, 201 bp, Bos taurus
caaatggattgctggcctgtgagtagtcaggaacagtctaaacaggcttttacacagttttctaggctgtatttgcattttcattaagttggcactttgayctataccttactgataatgtaccagcgtcagatactttgttagtccttcacctgagctatgtactaatcataagactaaatggttgagatttagaaattg

SEQ ID NO: 116245 - DNA, 201 bp, Bos taurus
ggattttcatttgttgagacctcttagaaatgacagaatctttctttaaactgagatcaaagaatcgattaggatttggtgaaactatactcgtatgtcargcctgcttccagagtccaaattctcatgaaattaagtggggtttggcattcccaaatctcctctacttccccactcataattatgtacaatgccttttat

SEQ ID NO: 116246 - DNA, 201 bp, Bos taurus
caggatggttaaatccctcacctccttcaagtcttcactgaaatatcactatttttattaagaccatcttgaccatgctatttaaaattatatcctccttyactcttgatcccctgaattcttttttccaccttttcatccatcatacttatcaacttatagaacttatttatttgaaatattttattgtctgtcttatcc

SEQ ID NO: 116247 - DNA, 201 bp, Bos taurus
caaaaaaaacatcaactaaccacactacaggacagaatgaaaaagctactgatagatgtaccttttcatctttaaaatatgctaaggcagtgcagctatgkgacctgtgaattctgaagtgaagccaggaatgtaggctgggaaggttctacagaggtatgtgagagaacttacatacatgtacggatagaccctgatgta

SEQ ID NO: 116248 - DNA, 201 bp, Bos taurus; identical to SEQ ID NO: 35229

SEQ ID NO: 116249 - DNA, 201 bp, Bos taurus
aggtcatataaaaagcaacagaaaagttacataaacaaagcagcttggtcagagagagagaaatttatttgtccctcccatgcttcagtcgggcttcccargcggtgcaaagatacagaatccttctgccaatgcgggagacacaagagatgcagatttgatccctgcatcagaaagatcccctggaggaggagatggcaa

SEQ ID NO: 116250 - DNA, 201 bp, Bos taurus
gagagcagcgccctcagggggcaggggacagggccggctcagtcctactcaatcaacaccccccctcccctgcaccgcctcccctttgtgtctttttacaygacagtcaatagaggccgggcctcgagggtattatcagagccccgatcgcgacctctaacattataatccacgaggctgcggggagcatcagtacatcct

SEQ ID NO: 116251 - DNA, 201 bp, Bos taurus
ctgccgagacgcgcattcacctgtggtctctgtccctcaggtgacccgttctctgctgtgctcactgcgaagcttttgggcttactggccttatatctcayactcttctttgggatggctgctcccaaatgacatcttctaactgtgttggagaagactcttgagagtccctaggacagcaaggagatccaaccagtccat

SEQ ID NO: 116252 - DNA, 201 bp, Bos taurus
ggcgatactcttgtccctgacatccccctggggccctcggggcccttcaccaaaagtaccccgaccagaagccgcgctttcacaggacactcactctaacrgcactgctgaaaggcccggccatccgctcttccctagaagcccgcggccttctcactgccttctgaagtcctgctcaggcctcccgccggctctcaggag

SEQ ID NO: 116253 - DNA, 201 bp, Bos taurus
ttcatcagcgctccagtcattaaaccatcaggagcagggagaggacttcacactcgtttaaaaaaaaaaaaagagcatgctagtatgtagtgacctaagcrtggaaatcacacatttaaaaatagctctcaaaagcatttatagaatgaagtctctaaaacctgcctaggaagtagaaatgattattattataacctcacc

SEQ ID NO: 116254 - DNA, 201 bp, Bos taurus
tttacaaaacctattttgaaacaaatttctaggaatcttcggaaagatggaatgaggtgaaatgcttcccacactcccttgttcctatgtgaactctgagscccatgcaagcaccattttcccactccaggtgtagacttcaattaaactgtaggaaacaaaaagatttgctttactgcgaagcctgtcccctttccattt

SEQ ID NO: 116255 - DNA, 201 bp, Bos taurus
tttaggcatagctacgtgaaataaacttcatgttttatggcaagacaagaacaatttaaacataaattcttccctgccctttggcccccctctccccctcrgtgccttgcattgcgtctgctccagccctccccaaccatgaagaagggataccctctcaaccacaaagagcagtattctcccggccccaccaaggtaact

SEQ ID NO: 116256 - DNA, 201 bp, Bos taurus
gggctttgtttttatttggaaagctcaggtggggtttggtctaagtgctttgtaaactataaatcactatctgagtagttttactcagagtcttcgactgyctttatcagtttgagtgtttagagccagggggcccaattggtacattacgtggttcttattctgggaaaagctccaatgttttctgaacattttgttcag

SEQ ID NO: 116257 - DNA, 201 bp, Bos taurus
cagggctcgtgtcccctaagaggccagatggcagatgctgagctgctctcaggacgagatgctctcaggacagactgatccagagagactgagcttaaggyaaacatggccacacccccactccctgcatgaaggtacaatcaatgaaaaaactttgcacccaaagaaatcatttcgtcatcaaccagctacaaagtggta

SEQ ID NO: 116258 - DNA, 201 bp, Bos taurus
aaggtcagaggtgtgaggcctcgtatcaaggccacagacacggagccccacgccaaggtcatctccagatcggactgagctccatagcaactgttgccatragcccccttgatccaaactggccagctccctgaccttaaccaatcacctgatgccacccttccagctggaatcttctttgtctcgaggctataaaggttg

SEQ ID NO: 116259 - DNA, 201 bp, Bos taurus
ttttccccatttgaattgtctctacttgcttttaaattaaggaaatatcatcattatgggacattatcttttgaaataacagagtttatctccaagctttyctttgtatagtctattatgtcctttgaagaatacagatgtagaagaaaatgattttttaaaaaatctgactcattcaaaattgcttactttctcctttta

SEQ ID NO: 116260 - DNA, 201 bp, Bos taurus
actgagggccagagatgcgagtgaagtgacttctggaattcacacaggtagttcagagcagagccaagacttgaatgcaggtctcttgaccctaaacctcrgtgctctgagtgtgaggcctgtggagatggaagcttccagaaaatgctggaggggagagtaagagggtaggatgcaggctgcctggagctacccaggtgg

SEQ ID NO: 116261 - DNA, 201 bp, Bos taurus
tatgcctcctttgaagaaagaatattcttcttaacgtgtgtatgtaggttataagagggactggaagatgccatttgaaataacatcaaagaggccagackagtcagattacagaagcctgtgagaggcagattcagaaatattcttgaatttgaggctagaaggagcatttgtgggtgtgggggtgagtaagggagcaga

SEQ ID NO: 116262 - DNA, 201 bp, Bos taurus
ctggagagggatgagaaacccactggagctgacaggcgtgttaaacggtactgacgacggggcacacgtgcctgccgagagcagggctgcttttgcacacrcctgaaatctttgcagtggccttgtcctgcccattcgacggatgagaaaactgactcagaagtagggaccccgtccccgcaaggttcttcggagagtggg

SEQ ID NO: 116263 - DNA, 201 bp, Bos taurus
gaccccgcaaaccactccctcaccccaagccctggttctccagggagaggagcctggtgcctgggaaacaagctgggcaagctggtgctggcctcctgggyagcgcgggctcccctgccttcgtgaatcggctctttcatgtggaaattgcatgagggctaacaggacagaggtcctgcgaacccacacgattcctgcccc

SEQ ID NO: 116264 - DNA, 201 bp, Bos taurus
cccagctggctctatgacgaggctgtgctgggcacttgggagttccacacgtctatgtgtgtgatttgtaaagaacaaagttcttgaaatgttttgtgctygagtctttcctgtttagcatgatacaaagagtcctttaggcttgggttttctctcctataagctgttaaaaatgtcagaactccactatgtattttattg

SEQ ID NO: 116265 - DNA, 201 bp, Bos taurus
cgtcaaccacgggggagaggagtgaagacacagagcacagggcgggtgggccttgaaaacgtggggctaagaaaagccagtcacagcaaggccacgtgccrcacaaagccgcttatgtgacgtgtccagaacaggcacatccacagaaataggaggtgagttagtggccacctgcggctgcaggaagagtagaatgagact

SEQ ID NO: 116266 - DNA, 201 bp, Bos taurus
ggccacgacgggggctgcgtctgttcagtgctcgtgggtctccctcaccagactgtcagctccaggagggcaggggccttcgtgtggtcttgtttgctgcygcagccccagcacaggatggatgctcagcaaatctgtcgagtaactgagtgcggagaaggaaggtggtggggctggaggcaggcagctcgctgaagcgcg

SEQ ID NO: 116267 - DNA, 201 bp, Bos taurus
acctctgtgtttatccagagagccagcaactctggagaggggaatgctgacgcttgttcttgagactaaaaacctcttagccaggcagtgagacaacatayaaaacaaactttagaaaagactacaaagattattattaaattgaattgaattatatagtttttattctcttagaacaatggaatcaggaatgcaggcaga

SEQ ID NO: 116268 - DNA, 201 bp, Bos taurus
agagctctcatcaaacaaatttagctgtggccaaagcaagttattgccaactttaaattatggaagatgactgtgtccataatacccttatgaacagaatyggcccggattttagtaagtaaaagtgttagtcactcaatcatgtttgactctttgcaaccccacggactgtagcccatcaggctcctctgtccatggaat

SEQ ID NO: 116269 - DNA, 201 bp, Bos taurus
tgcagcttccacaccgctctccccttcgatcacctgtcccaggggagccagctgtcacacgagcaggacactcaggcagctgcacggaaagggccacagakcgaggacctgaagcgtcctgccgacaacacgcgagtaagctgtcttgaaagggcatctcctgccccagacaagtcttcaggtgaatgcagtcctggccaa

SEQ ID NO: 116270 - DNA, 201 bp, Bos taurus
cggatggggatggtgtataaaggctgggttttgtttttgggctgcgctgcaccgcagagttgcccaaccaggtatcaaatccatatgtaaaggctcttttkaatccagctctttctacctatgtaaatttgcatagtttctcctccaaatagtcagcttgctcttgagcaggagggattattgcataacctaagaacatgt

SEQ ID NO: 116271 - DNA, 201 bp, Bos taurus
atgacttctggcttgattgattaggcagataacttgtgatcaagaatagagtaggggcttccctggtggaccagtggtaaagactgtgtttccaatgcagsgggtgtgggtttgatcccacgtgtcacacagtgcggcagaaaaaaaccaagaatagagtagcaaaaatacaaaaggaatagggctgagataggaaagggg

SEQ ID NO: 116272 - DNA, 201 bp, Bos taurus
tagggccaaaaaaaccatttccatcattcgtactactcatgagagataacactatcaaaaggccatgtttgtagatttccagaagtttgctctcgtaagaraatataaaaaagaagtaattgaaaaatgcacttttctgtgtcttcactgctttttaaaaaagtgtttttaaaatagattttcttagggaatagatcagat

SEQ ID NO: 116273 - DNA, 201 bp, Bos taurus
gaaggtagatccaaagggcagagtggaaatggttgggtgggaacagatggaggatgggtgaaggcagaggaagtaaagaacagaataatgaggataaaagyacagtagacattaaatcattagagagatctacaatctgggtatttatgtgaaggataacaggaatacaaagcgtggtgaaattagttggtgtcaaagatt

SEQ ID NO: 116274 - DNA, 201 bp, Bos taurus; identical to SEQ ID NO: 35232

SEQ ID NO: 116275 - DNA, 201 bp, Bos taurus; identical to SEQ ID NO: 35233

SEQ ID NO: 116276 - DNA, 201 bp, Bos taurus; identical to SEQ ID NO: 35238

SEQ ID NO: 116277 - DNA, 201 bp, Bos taurus; identical to SEQ ID NO: 35240

SEQ ID NO: 116278 - DNA, 201 bp, Bos taurus; identical to SEQ ID NO: 35329

SEQ ID NO: 116279 - DNA, 201 bp, Bos taurus; identical to SEQ ID NO: 35334

SEQ ID NO: 116280 - DNA, 201 bp, Bos taurus
acatggacccctgcatagactacccgagtttcctcacagcctgagtgattctggagggagcaagttagaacaatctgacagaatccacagaggcttttcaytacctagtctctgatgtcacaaactgccacttcctccttattttacctattagaagacaggaaataagacagcactcgggggaagtaaatataggctcta

SEQ ID NO: 116281 - DNA, 201 bp, Bos taurus; identical to SEQ ID NO: 35476

SEQ ID NO: 116282 - DNA, 201 bp, Bos taurus
tatttaatcacaattgtgtagaatcatatagaattggaattttaaaaatgagtttttctcatgttagccccattcttatctaataggggagtttttctcaygaagcacttaagaattaataaattatattaccatgaattcattctgatgatataataagtatcagatttaacaatcatgaaaacaaaaacaaatttggca

SEQ ID NO: 116283 - DNA, 201 bp, Bos taurus
cataacttcacagaaggaaagtaacccaactctaaagaaaaaagtgtttcttgaaacctgaacatttgagtcacaacaagtatctgacccagttctgcagrcatgaattcttgctgccagcaaaaacagtagactgaaagcagtcatttggactgctgtagaaaaaaaaatcattactcaacaacacaatcacattcccga

SEQ ID NO: 116284 - DNA, 201 bp, Bos taurus
aaggaaccaagtctgccgacactttggttctagacttctaacctccagaactataagaactacaaattaattcctactgtataagtcacccagcctgtggyagtttgttatgctggccctagtaaactaagataaaaaccttgtcccagttacctaattatctcgttccctcatctgtaaagcaaataaagacacaactga

SEQ ID NO: 116285 - DNA, 201 bp, Bos taurus
agaaattcatctcccaagtgtcacgctcagcagagttgcaccagcttctataacagatgtctagacaatttgactttgaaatacataccccacacctaaayggcctgaagtttcccagtcagtgcccagccaaagttcaaaaccagagaccacacaggaatagaggattgaagattataaataaacttattcatagggaaa

SEQ ID NO: 116286 - DNA, 201 bp, Bos taurus
gctctccgccgccagactgcggttgtggtcaacaagagaagcgctaccgccgtcccggcttccgtaggcagacggttcggcggccccggatgttgatacaycacctgccccggaaacggtggtgggaagcccaagggggcgggggcggcgttgccgggctctccggaaggagacgtggcggcggttgggccccgggctgcc

SEQ ID NO: 116287 - DNA, 201 bp, Bos taurus; identical to SEQ ID NO: 35482

SEQ ID NO: 116288 - DNA, 201 bp, Bos taurus; identical to SEQ ID NO: 35483

SEQ ID NO: 116289 - DNA, 201 bp, Bos taurus; identical to SEQ ID NO: 35487

SEQ ID NO: 116290 - DNA, 201 bp, Bos taurus
acaaggcacagttcaagtactcagcagccgtgcgtggccagtggtgaccatgctggacagtgcaggtttagatattcttcttccacttaccctttggaaaygatctcttctggccgtcctcctgccactccaaccgttccttctcagggccccatgtctgcttcctcttccagcccctcatatgctattggtgcttaggat

SEQ ID NO: 116291 - DNA, 201 bp, Bos taurus; identical to SEQ ID NO: 35488

SEQ ID NO: 116292 - DNA, 201 bp, Bos taurus; identical to SEQ ID NO: 35490

SEQ ID NO: 116293 - DNA, 201 bp, Bos taurus; identical to SEQ ID NO: 35494

SEQ ID NO: 116294 - DNA, 201 bp, Bos taurus; identical to SEQ ID NO: 35495

SEQ ID NO: 116295 - DNA, 201 bp, Bos taurus; identical to SEQ ID NO: 35496

SEQ ID NO: 116296 - DNA, 201 bp, Bos taurus; identical to SEQ ID NO: 35497

SEQ ID NO: 116297 - DNA, 201 bp, Bos taurus
tagagcaatgggccagtgaaatcaggatcattaatttgatcattgtcttagccagtcttgtaaatacatgccatcctctgccatgaggggctggtgaaaamgtaacttaagcttacaaggccatgggcactagggggacatggaacgccacatgtttcttctaactggaagggagttggttatattctcttggtttatgaa

SEQ ID NO: 116298 - DNA, 201 bp, Bos taurus
cctccctgtccatcaccaactcctggagtttactcaaactcatatccattgagtcagtgatgacatccaattgcaagcctctccagcttatttctctacaraaaactttacaggccagaagggagtggcatgatatagttaaagccctacaagggaaaaaactacaatctaggatactcttacctggattagaacagaaga

SEQ ID NO: 116299 - DNA, 201 bp, Bos taurus; identical to SEQ ID NO: 35501

SEQ ID NO: 116300 - DNA, 201 bp, Bos taurus
gattagagatctcatcaagaaaattggagataccaagggaacatgtcaggaaaggatgggcacgataaaggatagaaactgtaagggcctaacagaagccraagacattcagaagaggtggcaaaaatacacagaagaactatatagcacagggaactctacaatactctgcaatggcctatatgggaaataaatctaaaa

SEQ ID NO: 116301 - DNA, 201 bp, Bos taurus; identical to SEQ ID NO: 35505

SEQ ID NO: 116302 - DNA, 201 bp, Bos taurus; identical to SEQ ID NO: 35509

SEQ ID NO: 116303 - DNA, 201 bp, Bos taurus; identical to SEQ ID NO: 35510

SEQ ID NO: 116304 - DNA, 201 bp, Bos taurus; identical to SEQ ID NO: 35511

SEQ ID NO: 116305 - DNA, 201 bp, Bos taurus; identical to SEQ ID NO: 35512

SEQ ID NO: 116306 - DNA, 201 bp, Bos taurus; identical to SEQ ID NO: 35513

SEQ ID NO: 116307 - DNA, 201 bp, Bos taurus; identical to SEQ ID NO: 35514

SEQ ID NO: 116308 - DNA, 201 bp, Bos taurus; identical to SEQ ID NO: 35515

SEQ ID NO: 116309 - DNA, 201 bp, Bos taurus; identical to SEQ ID NO: 35516

SEQ ID NO: 116310 - DNA, 201 bp, Bos taurus; identical to SEQ ID NO: 35517

SEQ ID NO: 116311 - DNA, 201 bp, Bos taurus; identical to SEQ ID NO: 35518

SEQ ID NO: 116312 - DNA, 201 bp, Bos taurus; identical to SEQ ID NO: 35519

SEQ ID NO: 116313 - DNA, 201 bp, Bos taurus; identical to SEQ ID NO: 35523

SEQ ID NO: 116314 - DNA, 201 bp, Bos taurus
taggaacttctcggctaggttcttgtgctactggcttcatgttcatatcaaaagtgctgtattcaggaagggcatctcgcaagtacagcaaactatcgtcragccgtttctctaatttgacaacttggatctcctggattcgaggattataaagttcaaagcaaatctcaacacctaaaaagagaaaacatattcttacaa

SEQ ID NO: 116315 - DNA, 201 bp, Bos taurus
tcttagtcccaggaattattctgtgggttggggtctaaacacagcatgggaagaagccctcaagcacccaagcatctctaggggccacaggactgggacayggacacccagaactccgacaaatgccagctgcccgtgtcaggcgttcagggtcagtcaggccctgttgtatctcccagcgtgctggtccaccgcccaccc

SEQ ID NO: 116316 - DNA, 201 bp, Bos taurus
gttcatcagcgtcgtcttgccctcagccctccgccttctctcagccatgagtctgcactcccacccccacctcactggtctttctgatgggcctgaggctygcagcatctgggtccacaaccttcatccagggctctatcccagggcttccagcagaaggcagctgagggccccagatgtgggctccaggagcctcttggc

SEQ ID NO: 116317 - DNA, 201 bp, Bos taurus
cactgacctagagccagatatcctggaatgtgaagtcaaatgggccttagaaagcatcactacgaacaaagctagtggaggtgacagaattccagttgagstattccaaatcctgaaaggcctttcaggtaggaccaaaatcaaatcccttacgattatacagtagaagcaacaaaccgagtaaaaaaaaaaaaagtgaca

SEQ ID NO: 116318 - DNA, 201 bp, Bos taurus; identical to SEQ ID NO: 35526

SEQ ID NO: 116319 - DNA, 201 bp, Bos taurus; identical to SEQ ID NO: 35527

SEQ ID NO: 116320 - DNA, 201 bp, Bos taurus; identical to SEQ ID NO: 35528

SEQ ID NO: 116321 - DNA, 201 bp, Bos taurus; identical to SEQ ID NO: 35530

SEQ ID NO: 116322 - DNA, 201 bp, Bos taurus
taactagaagatccccccagaccttgtcagctgagcgaagcagctctaagtgtcttcattttgttccccagctcagctcaaggccatagtcacagagactyaaaacacagcatttctcagctgtatgggtacaagtgatctggtagcaaggtggccagggaggtaatcacagctgtgtgtgtgtgtgtgtgtgtgtgtgtg

SEQ ID NO: 116323 - DNA, 201 bp, Bos taurus; identical to SEQ ID NO: 74987

SEQ ID NO: 116324 - DNA, 201 bp, Bos taurus; identical to SEQ ID NO: 35532

SEQ ID NO: 116325 - DNA, 201 bp, Bos taurus; identical to SEQ ID NO: 35533

SEQ ID NO: 116326 - DNA, 201 bp, Bos taurus; identical to SEQ ID NO: 35534

SEQ ID NO: 116327 - DNA, 201 bp, Bos taurus; identical to SEQ ID NO: 74988

SEQ ID NO: 116328 - DNA, 201 bp, Bos taurus; identical to SEQ ID NO: 35535

SEQ ID NO: 116329 - DNA, 201 bp, Bos taurus; identical to SEQ ID NO: 35537

SEQ ID NO: 116330 - DNA, 201 bp, Bos taurus; identical to SEQ ID NO: 74992

SEQ ID NO: 116331 - DNA, 201 bp, Bos taurus; identical to SEQ ID NO: 74993

SEQ ID NO: 116332 - DNA, 201 bp, Bos taurus; identical to SEQ ID NO: 35538

SEQ ID NO: 116333 - DNA, 201 bp, Bos taurus; identical to SEQ ID NO: 74994

SEQ ID NO: 116334 - DNA, 201 bp, Bos taurus; identical to SEQ ID NO: 35541

SEQ ID NO: 116335 - DNA, 201 bp, Bos taurus; identical to SEQ ID NO: 35542

SEQ ID NO: 116336 - DNA, 201 bp, Bos taurus; identical to SEQ ID NO: 35544

SEQ ID NO: 116337 - DNA, 201 bp, Bos taurus; identical to SEQ ID NO: 35546

SEQ ID NO: 116338 - DNA, 201 bp, Bos taurus; identical to SEQ ID NO: 35547

SEQ ID NO: 116339 - DNA, 201 bp, Bos taurus; identical to SEQ ID NO: 35548

SEQ ID NO: 116340 - DNA, 201 bp, Bos taurus; identical to SEQ ID NO: 35549

SEQ ID NO: 116341 - DNA, 201 bp, Bos taurus; identical to SEQ ID NO: 35550

SEQ ID NO: 116342 - DNA, 201 bp, Bos taurus; identical to SEQ ID NO: 35552

SEQ ID NO: 116343 - DNA, 201 bp, Bos taurus; identical to SEQ ID NO: 35553

SEQ ID NO: 116344 - DNA, 201 bp, Bos taurus; identical to SEQ ID NO: 35554

SEQ ID NO: 116345 - DNA, 201 bp, Bos taurus
gttgttcagggcggcctcgcgcatcttgtggtacatgaattcgttctggcggaacatgcgcagttccatctccgtctgcatccgcatggcctgtgggacgyggatacatcggaaacagtgatgacaaagccccaggacgtgtcggtctctgacttatgttggccctgctggaaaggacacatatacaccctacacacacat

SEQ ID NO: 116346 - DNA, 201 bp, Bos taurus; identical to SEQ ID NO: 75007

SEQ ID NO: 116347 - DNA, 201 bp, Bos taurus; identical to SEQ ID NO: 75008

SEQ ID NO: 116348 - DNA, 201 bp, Bos taurus; identical to SEQ ID NO: 35555

SEQ ID NO: 116349 - DNA, 201 bp, Bos taurus; identical to SEQ ID NO: 35556

SEQ ID NO: 116350 - DNA, 201 bp, Bos taurus
gttattgaagggatgtttcggtatactgatttaagggggaaagtcactttaataaatggatattgttgttgtttagttgccacattatgtctaactctgcraacccatggactgtatgtagtcctccaggctcttttgtctgtgggatttcccaggcaagaatacgggttgttgttgttcagacaacagaatactgttgct

SEQ ID NO: 116351 - DNA, 201 bp, Bos taurus
agtgggacggagaaggacacctctgaatctcgcgtccccttgtctgagtcctttggcggggggtttgaaggagagagatagacaggtatctatctccgggmaatttccaagtgacagacggccaccctgacggtggcgatgacacctcctcggccttgcaggagagcgcagagtcatccggggtgaggcctgcgtgaagtc

SEQ ID NO: 116352 - DNA, 201 bp, Bos taurus; identical to SEQ ID NO: 75011

SEQ ID NO: 116353 - DNA, 201 bp, Bos taurus; identical to SEQ ID NO: 35559

SEQ ID NO: 116354 - DNA, 201 bp, Bos taurus
actgatatatcagctgtggagtgtgagtaaaagaaacacatcaaggaagaatctttaccaaaaaaaaaaaaattatttgactgcactggttcttagttgcrgcatgtaagatcttgttccactagcagggatcgaacccaggccccctatattggaagaacagagtcttagccactggaccaccaggaaagtctcaaggaa

SEQ ID NO: 116355 - DNA, 201 bp, Bos taurus; identical to SEQ ID NO: 35567

SEQ ID NO: 116356 - DNA, 201 bp, Bos taurus; identical to SEQ ID NO: 75023

SEQ ID NO: 116357 - DNA, 201 bp, Bos taurus; identical to SEQ ID NO: 35573

SEQ ID NO: 116358 - DNA, 201 bp, Bos taurus; identical to SEQ ID NO: 35574

SEQ ID NO: 116359 - DNA, 201 bp, Bos taurus; identical to SEQ ID NO: 75026

SEQ ID NO: 116360 - DNA, 201 bp, Bos taurus; identical to SEQ ID NO: 75028

SEQ ID NO: 116361 - DNA, 201 bp, Bos taurus; identical to SEQ ID NO: 35575

SEQ ID NO: 116362 - DNA, 201 bp, Bos taurus; identical to SEQ ID NO: 35576

SEQ ID NO: 116363 - DNA, 201 bp, Bos taurus; identical to SEQ ID NO: 75029

SEQ ID NO: 116364 - DNA, 201 bp, Bos taurus
cttttcatggcctttatttcaaagtctattttctgatatgagtattgctactcctgctttcttttggtttccatttgcgtgatctatctttttccttgttytgaggtgggcctcttatagaaaaggtatataggggtcttgtttttgtatccattcaaccagtttttgtcttttggttggggcattccacccattttcatt

SEQ ID NO: 116365 - DNA, 201 bp, Bos taurus; identical to SEQ ID NO: 75035

SEQ ID NO: 116366 - DNA, 201 bp, Bos taurus
tgatctgatcaaatctcattttccatgggaaaatcaaattcaatgaatagagcaggtgagccagtgaagaatccatttgtttacatgatgtagtatgaaayatcctgaaagttccacctcaaccatgttacctccaggcttaaaacactcactgttggcttgaggcaccatctctcaaaatctctacaacatcagaatctt

SEQ ID NO: 116367 - DNA, 201 bp, Bos taurus; identical to SEQ ID NO: 35583

SEQ ID NO: 116368 - DNA, 201 bp, Bos taurus; identical to SEQ ID NO: 35584

SEQ ID NO: 116369 - DNA, 201 bp, Bos taurus; identical to SEQ ID NO: 75039

SEQ ID NO: 116370 - DNA, 201 bp, Bos taurus; identical to SEQ ID NO: 35587

SEQ ID NO: 116371 - DNA, 201 bp, Bos taurus
cctgctagcagatctaaagttaaagggcaaatagttccgtggtctgcatgaaaatgaaaggctagcatatttttccaagttgaataaaaatgtactgttartataaatatcctttttcagaagccacaaagggaagagaggcaacaattttgttctagtgctgcattctgccttaagtaggcaaatataggacagagtgct

SEQ ID NO: 116372 - DNA, 201 bp, Bos taurus
agcctaaactctttctgctcctaggattatatatgttcgctatagaaactctcagcttttataagctcaaactaacagtagaacaccaggcacttgccatytagtaagttatttccacctcctctgaagctaattcttgctcatgtcagataaatggtctcatttgtcaataaaaccacaatttgccatggtatataatct

SEQ ID NO: 116373 - DNA, 201 bp, Bos taurus; identical to SEQ ID NO: 35595

SEQ ID NO: 116374 - DNA, 201 bp, Bos taurus; identical to SEQ ID NO: 75048

SEQ ID NO: 116375 - DNA, 201 bp, Bos taurus
aaaatccaaggtgttttctcattaactatcctccatgattgcagaagaatttgacctgattgcaacagcattcccagtttggattgatcactgtctttttygcagaatattctattctcctggattcaagattctgtactctgtttgctctctggtcacatttcaaggcatgcctttcctctctgattcatttctatccca

SEQ ID NO: 116376 - DNA, 201 bp, Bos taurus; identical to SEQ ID NO: 35596

SEQ ID NO: 116377 - DNA, 201 bp, Bos taurus
ccagtattcttgcctgaagaatcccatggacagaggagcctggcaggctacagagtcggacacagctgaagcgactgagcatgcatgcatacaagcacacrtgctacttcaaaatataactgtttcttccatagaaatctaaatacacaagtcatttccttcatgaatctccttaattctttcagtgagacgtaatatccc

SEQ ID NO: 116378 - DNA, 201 bp, Bos taurus; identical to SEQ ID NO: 75072

SEQ ID NO: 116379 - DNA, 201 bp, Bos taurus; identical to SEQ ID NO: 35618

SEQ ID NO: 116380 - DNA, 201 bp, Bos taurus; identical to SEQ ID NO: 35620

SEQ ID NO: 116381 - DNA, 201 bp, Bos taurus; identical to SEQ ID NO: 35621

SEQ ID NO: 116382 - DNA, 201 bp, Bos taurus; identical to SEQ ID NO: 35622

SEQ ID NO: 116383 - DNA, 201 bp, Bos taurus; identical to SEQ ID NO: 35623

SEQ ID NO: 116384 - DNA, 201 bp, Bos taurus
attttatatagtgctttatcattctctcttgctctctatgtcatttattctccttaacattaaccttgatagccctttacttataagtgctgaagtgtgtrtttcttaaaaacaagaatgttttcttgcctagccaaggttcagtttaccaaatcaggaaattaaacattgataaaatactattacttaatttatggacct

SEQ ID NO: 116385 - DNA, 201 bp, Bos taurus; identical to SEQ ID NO: 75087

SEQ ID NO: 116386 - DNA, 201 bp, Bos taurus; identical to SEQ ID NO: 35624

SEQ ID NO: 116387 - DNA, 201 bp, Bos taurus; identical to SEQ ID NO: 35626

SEQ ID NO: 116388 - DNA, 201 bp, Bos taurus; identical to SEQ ID NO: 35627

SEQ ID NO: 116389 - DNA, 201 bp, Bos taurus; identical to SEQ ID NO: 75090

SEQ ID NO: 116390 - DNA, 201 bp, Bos taurus; identical to SEQ ID NO: 35628

SEQ ID NO: 116391 - DNA, 201 bp, Bos taurus; identical to SEQ ID NO: 35630

SEQ ID NO: 116392 - DNA, 201 bp, Bos taurus; identical to SEQ ID NO: 35631

SEQ ID NO: 116393 - DNA, 201 bp, Bos taurus; identical to SEQ ID NO: 35633

SEQ ID NO: 116394 - DNA, 201 bp, Bos taurus; identical to SEQ ID NO: 35634

SEQ ID NO: 116395 - DNA, 201 bp, Bos taurus; identical to SEQ ID NO: 35636

SEQ ID NO: 116396 - DNA, 201 bp, Bos taurus; identical to SEQ ID NO: 35637

SEQ ID NO: 116397 - DNA, 201 bp, Bos taurus
agaagtagtacacagcaacccagaaacatggacattggaactgaagctgatgaaacaggaaccaaataagctgtattctttggccagcatgctcaggaagytggcattttttggtttgtttatttgttcacctaagtccaggggtctgaagactctggcccatgagccaagtctggcccactatttgtttataaatgaggc

SEQ ID NO: 116398 - DNA, 201 bp, Bos taurus
aggaaatggcaacccactccaatattcttgcctgacaaatcccatggacagaggagcctggcagtttacaatctgtggggtcacaaagaatcggccatgaytgagcgactgatgcacacaggcacgcatgtgtttaaaatatctattctgaaatcagttacatttttcattctgggttgtagacagtgagttagaaggcca

SEQ ID NO: 116399 - DNA, 201 bp, Bos taurus; identical to SEQ ID NO: 35642

SEQ ID NO: 116400 - DNA, 201 bp, Bos taurus
gctatcagctagaactttaaaacatcaaaacacagattatataaaattccaaggaaatgataggattgcaaaaacaggcttcgtctagagtatgaacttaygatttggagactgtgggttactaaggggtccagagacaagcctagaggcgtggggccctctgaaattgtgcacagttctcaaagaggtgatgacttctaa

SEQ ID NO: 116401 - DNA, 201 bp, Bos taurus; identical to SEQ ID NO: 35643

SEQ ID NO: 116402 - DNA, 201 bp, Bos taurus; identical to SEQ ID NO: 35645

SEQ ID NO: 116403 - DNA, 201 bp, Bos taurus
cccttcccttcctttcgttcagctaaatattactaatgactaaggaatctataaactatagtgacagactgccaaggtaccctaaagataaagcattcttscaggaattttgagttataaaaaagcttatagaatcctaagagaagggagggactgattgtttagggatgtaaagaagacatctcaaaagagggacacaag

SEQ ID NO: 116404 - DNA, 201 bp, Bos taurus; identical to SEQ ID NO: 35648

SEQ ID NO: 116405 - DNA, 201 bp, Bos taurus; identical to SEQ ID NO: 35649

SEQ ID NO: 116406 - DNA, 201 bp, Bos taurus; identical to SEQ ID NO: 35650

SEQ ID NO: 116407 - DNA, 201 bp, Bos taurus; identical to SEQ ID NO: 35651

SEQ ID NO: 116408 - DNA, 201 bp, Bos taurus; identical to SEQ ID NO: 35652

SEQ ID NO: 116409 - DNA, 201 bp, Bos taurus; identical to SEQ ID NO: 35653

SEQ ID NO: 116410 - DNA, 201 bp, Bos taurus; identical to SEQ ID NO: 35654

SEQ ID NO: 116411 - DNA, 201 bp, Bos taurus; identical to SEQ ID NO: 35655

SEQ ID NO: 116412 - DNA, 201 bp, Bos taurus; identical to SEQ ID NO: 35656

SEQ ID NO: 116413 - DNA, 201 bp, Bos taurus; identical to SEQ ID NO: 35657

SEQ ID NO: 116414 - DNA, 201 bp, Bos taurus; identical to SEQ ID NO: 35659

SEQ ID NO: 116415 - DNA, 201 bp, Bos taurus; identical to SEQ ID NO: 35660

SEQ ID NO: 116416 - DNA, 201 bp, Bos taurus; identical to SEQ ID NO: 35661

SEQ ID NO: 116417 - DNA, 201 bp, Bos taurus; identical to SEQ ID NO: 35662

SEQ ID NO: 116418 - DNA, 201 bp, Bos taurus; identical to SEQ ID NO: 35663

SEQ ID NO: 116419 - DNA, 201 bp, Bos taurus; identical to SEQ ID NO: 35664

SEQ ID NO: 116420 - DNA, 201 bp, Bos taurus; identical to SEQ ID NO: 35665

SEQ ID NO: 116421 - DNA, 201 bp, Bos taurus; identical to SEQ ID NO: 35666

SEQ ID NO: 116422 - DNA, 201 bp, Bos taurus; identical to SEQ ID NO: 35667

SEQ ID NO: 116423 - DNA, 201 bp, Bos taurus; identical to SEQ ID NO: 35668

SEQ ID NO: 116424 - DNA, 201 bp, Bos taurus; identical to SEQ ID NO: 35669

SEQ ID NO: 116425 - DNA, 201 bp, Bos taurus; identical to SEQ ID NO: 35670

SEQ ID NO: 116426 - DNA, 201 bp, Bos taurus; identical to SEQ ID NO: 75129

SEQ ID NO: 116427 - DNA, 201 bp, Bos taurus; identical to SEQ ID NO: 35671

SEQ ID NO: 116428 - DNA, 201 bp, Bos taurus; identical to SEQ ID NO: 35672

SEQ ID NO: 116429 - DNA, 201 bp, Bos taurus; identical to SEQ ID NO: 35673

SEQ ID NO: 116430 - DNA, 201 bp, Bos taurus; identical to SEQ ID NO: 35674

SEQ ID NO: 116431 - DNA, 201 bp, Bos taurus; identical to SEQ ID NO: 35675

SEQ ID NO: 116432 - DNA, 201 bp, Bos taurus; identical to SEQ ID NO: 35676

SEQ ID NO: 116433 - DNA, 201 bp, Bos taurus; identical to SEQ ID NO: 35677

SEQ ID NO: 116434 - DNA, 201 bp, Bos taurus; identical to SEQ ID NO: 35678

SEQ ID NO: 116435 - DNA, 201 bp, Bos taurus; identical to SEQ ID NO: 35679

SEQ ID NO: 116436 - DNA, 201 bp, Bos taurus; identical to SEQ ID NO: 35680

SEQ ID NO: 116437 - DNA, 201 bp, Bos taurus; identical to SEQ ID NO: 35681

SEQ ID NO: 116438 - DNA, 201 bp, Bos taurus; identical to SEQ ID NO: 35682

SEQ ID NO: 116439 - DNA, 201 bp, Bos taurus; identical to SEQ ID NO: 35683

SEQ ID NO: 116440 - DNA, 201 bp, Bos taurus; identical to SEQ ID NO: 35684

SEQ ID NO: 116441 - DNA, 201 bp, Bos taurus; identical to SEQ ID NO: 35685

SEQ ID NO: 116442 - DNA, 201 bp, Bos taurus; identical to SEQ ID NO: 35686

SEQ ID NO: 116443 - DNA, 201 bp, Bos taurus; identical to SEQ ID NO: 35687

SEQ ID NO: 116444 - DNA, 201 bp, Bos taurus; identical to SEQ ID NO: 35689

SEQ ID NO: 116445 - DNA, 201 bp, Bos taurus; identical to SEQ ID NO: 35690

SEQ ID NO: 116446 - DNA, 201 bp, Bos taurus; identical to SEQ ID NO: 35691

SEQ ID NO: 116447 - DNA, 201 bp, Bos taurus; identical to SEQ ID NO: 35692

SEQ ID NO: 116448 - DNA, 201 bp, Bos taurus; identical to SEQ ID NO: 35693

SEQ ID NO: 116449 - DNA, 201 bp, Bos taurus; identical to SEQ ID NO: 35694

SEQ ID NO: 116450 - DNA, 201 bp, Bos taurus; identical to SEQ ID NO: 35695

SEQ ID NO: 116451 - DNA, 201 bp, Bos taurus
acttggcggggcctgcgacttccccccaaacagagcgggcacttgctcggtcttcggggcgctcctttcctttctagaactctgggattcggctaggggcrccaggtggggaggacaacaggcccacacttggggcagcaggacgagccctgggcagcggcccttctccagctttctgcgggcctgggccctgccccaccc

SEQ ID NO: 116452 - DNA, 201 bp, Bos taurus; identical to SEQ ID NO: 35696

SEQ ID NO: 116453 - DNA, 201 bp, Bos taurus; identical to SEQ ID NO: 35697

SEQ ID NO: 116454 - DNA, 201 bp, Bos taurus; identical to SEQ ID NO: 35698

SEQ ID NO: 116455 - DNA, 201 bp, Bos taurus; identical to SEQ ID NO: 35699

SEQ ID NO: 116456 - DNA, 201 bp, Bos taurus; identical to SEQ ID NO: 35700

SEQ ID NO: 116457 - DNA, 201 bp, Bos taurus; identical to SEQ ID NO: 35701

SEQ ID NO: 116458 - DNA, 201 bp, Bos taurus; identical to SEQ ID NO: 35702

SEQ ID NO: 116459 - DNA, 201 bp, Bos taurus; identical to SEQ ID NO: 35703

SEQ ID NO: 116460 - DNA, 201 bp, Bos taurus; identical to SEQ ID NO: 35704

SEQ ID NO: 116461 - DNA, 201 bp, Bos taurus; identical to SEQ ID NO: 35705

SEQ ID NO: 116462 - DNA, 201 bp, Bos taurus; identical to SEQ ID NO: 35706

SEQ ID NO: 116463 - DNA, 201 bp, Bos taurus; identical to SEQ ID NO: 35707

SEQ ID NO: 116464 - DNA, 201 bp, Bos taurus; identical to SEQ ID NO: 35708

SEQ ID NO: 116465 - DNA, 201 bp, Bos taurus; identical to SEQ ID NO: 35709

SEQ ID NO: 116466 - DNA, 201 bp, Bos taurus; identical to SEQ ID NO: 35710

SEQ ID NO: 116467 - DNA, 201 bp, Bos taurus; identical to SEQ ID NO: 35711

SEQ ID NO: 116468 - DNA, 201 bp, Bos taurus; identical to SEQ ID NO: 35712

SEQ ID NO: 116469 - DNA, 201 bp, Bos taurus; identical to SEQ ID NO: 35713

SEQ ID NO: 116470 - DNA, 201 bp, Bos taurus; identical to SEQ ID NO: 35714

SEQ ID NO: 116471 - DNA, 201 bp, Bos taurus; identical to SEQ ID NO: 35715

SEQ ID NO: 116472 - DNA, 201 bp, Bos taurus; identical to SEQ ID NO: 35716

SEQ ID NO: 116473 - DNA, 201 bp, Bos taurus; identical to SEQ ID NO: 35717

SEQ ID NO: 116474 - DNA, 201 bp, Bos taurus; identical to SEQ ID NO: 35718

SEQ ID NO: 116475 - DNA, 201 bp, Bos taurus; identical to SEQ ID NO: 75172

SEQ ID NO: 116476 - DNA, 201 bp, Bos taurus; identical to SEQ ID NO: 75174

SEQ ID NO: 116477 - DNA, 201 bp, Bos taurus
agactcacgtccatcgagtcagtgatgccatccagccatctcatcctctgtcgtccccctctcctcctgcccccaaacacacacatacagacatatacatrtacacaatatcctctcaaggtgtcatattttgaattttctaccatgttcaagaatattttatggcttttcaagtagcctaaaaccaaagcaaatcctgag

SEQ ID NO: 116478 - DNA, 201 bp, Bos taurus; identical to SEQ ID NO: 75175

SEQ ID NO: 116479 - DNA, 201 bp, Bos taurus; identical to SEQ ID NO: 35719

SEQ ID NO: 116480 - DNA, 201 bp, Bos taurus; identical to SEQ ID NO: 35721

SEQ ID NO: 116481 - DNA, 201 bp, Bos taurus
aaatcgatccctggtgctaaaaaggttgggcaccattctactccattgacagaccctaggacagaccttgtctcctggccattgcacatgctgacccctcrcagtgtttacctgggtgatgatcaacgagccttctcttagctcagacatctcggcctccctgtgtgccccccaggactcactctggcttataggcttggc

SEQ ID NO: 116482 - DNA, 201 bp, Bos taurus
tgagggacatatacccgcatttctgtgctgagtgacctggatgagtcctttcacatcccttggcctcgaaatggggccagtagtcccttccttgcagagtkacagcaagggttaatgggaacattggatgtgtgcagagctgctgactgcccctgctggccagtggccgcccagccgaggtggactttccagcctcctttg

SEQ ID NO: 116483 - DNA, 201 bp, Bos taurus
taaagtcaggtcttgtacaactagggacagcccctctgccccagtacctgctgaaattattcacgctggtcgattctaagtctgctcaccctgccttatcrtggctttcctttagaaaccaagataagggctgtgggtcatgttctccccctagctccttcctcatcctgactggtcctggtgctcctcttggttgccttg

SEQ ID NO: 116484 - DNA, 201 bp, Bos taurus; identical to SEQ ID NO: 75179

SEQ ID NO: 116485 - DNA, 201 bp, Bos taurus; identical to SEQ ID NO: 35727

SEQ ID NO: 116486 - DNA, 201 bp, Bos taurus; identical to SEQ ID NO: 35728

SEQ ID NO: 116487 - DNA, 201 bp, Bos taurus
acttatctcttgcaaaccacctccccaaagcctgctgaaattcttggggttgctgaaaggcagaagaaaattgatttcgccttgcatctcacagcaccccrgctgtgtttaacacaggggtatggctgtgtgtgttctcccgatatgcattgtaccatgggtttgtctgcttcagccataaaaaggctctgttacttctcc

SEQ ID NO: 116488 - DNA, 201 bp, Bos taurus
ggcataccttgactcttggtacaggcacataataggatcgcagtacatgccatgtgtagtaatgtgatacatggccccagaacagtggagatacttagtastcctgatgcctgtaggcaaagaaaagcacttgattctccatcagtaaatagaacaaatattttcaaacaaaatactagtgacaagagaactatttctatg

SEQ ID NO: 116489 - DNA, 201 bp, Bos taurus; identical to SEQ ID NO: 75181

SEQ ID NO: 116490 - DNA, 201 bp, Bos taurus; identical to SEQ ID NO: 35733

SEQ ID NO: 116491 - DNA, 201 bp, Bos taurus; identical to SEQ ID NO: 35734

SEQ ID NO: 116492 - DNA, 201 bp, Bos taurus; identical to SEQ ID NO: 35735

SEQ ID NO: 116493 - DNA, 201 bp, Bos taurus
ggattagatgaactagggagacacgcattgcgcacggagcccaacggaatgccaggtgttcagttaagggggggtgacggccatgactctgcttcagatgygctgcaactcctgctgcttttaaaactcctgcttcgggacttctggtggcccagcagttaagaatctgccttgcaatgcattgtaatagaggggacatgg

SEQ ID NO: 116494 - DNA, 201 bp, Bos taurus; identical to SEQ ID NO: 35738

SEQ ID NO: 116495 - DNA, 201 bp, Bos taurus; identical to SEQ ID NO: 35739

SEQ ID NO: 116496 - DNA, 201 bp, Bos taurus; identical to SEQ ID NO: 35743

SEQ ID NO: 116497 - DNA, 201 bp, Bos taurus; identical to SEQ ID NO: 35744

SEQ ID NO: 116498 - DNA, 201 bp, Bos taurus; identical to SEQ ID NO: 75190

SEQ ID NO: 116499 - DNA, 201 bp, Bos taurus; identical to SEQ ID NO: 35745

SEQ ID NO: 116500 - DNA, 201 bp, Bos taurus; identical to SEQ ID NO: 75193

SEQ ID NO: 116501 - DNA, 201 bp, Bos taurus
gcccagtacatactccatggaacttttagtggcttgagatggaactgggcaagatctgtatctatgtctgtgacaaaattgatccaaaaaaatattgcttmcatcactttataacatataagggaaaaagttatcttcagagtttgatagcaggaaaagtgtctttttgctgactaatgaatagagcttctcaggttgggg

SEQ ID NO: 116502 - DNA, 201 bp, Bos taurus
ggctgggagttcagccagatcaagtgggcttggcctggacgggaagtccgggggcctgaggtcagtggaatccagaagtcaccaaaggccattcagtgggrtgggtccaaacaggagaaggatcaagggcgaaaggttagctgcagccaggtctgaccttgctctggccgctactgcaaagctacccttggctgccagtcc

SEQ ID NO: 116503 - DNA, 201 bp, Bos taurus
cagaagagatgaagcaagagtgaaatggacagacgagaactggcctaaacaattccggaggcagaatgtgggtgagagtagtgtcttttaatgctctcacsccctggacttgagggagggggccaagctgggggtgtttcaggagctgggctcctatttgtccaggagtctctctggggctcaggcgaggaggccctgtcc

SEQ ID NO: 116504 - DNA, 201 bp, Bos taurus; identical to SEQ ID NO: 35749

SEQ ID NO: 116505 - DNA, 201 bp, Bos taurus; identical to SEQ ID NO: 35750

SEQ ID NO: 116506 - DNA, 201 bp, Bos taurus; identical to SEQ ID NO: 35753

SEQ ID NO: 116507 - DNA, 201 bp, Bos taurus
tgacggaagtcgatgctaacgagaggacctgatgcttcagcgtagttgcaggctgaggctctaggtggcgtaagcggcctgaggatgccagcagtcagccrcctggactctaggttctggtccaaggtcatggagacaacaactgttgaaatcaggactatggcctgcttctgactcgtcatctaggacccttcccacctc

SEQ ID NO: 116508 - DNA, 201 bp, Bos taurus; identical to SEQ ID NO: 35754

SEQ ID NO: 116509 - DNA, 201 bp, Bos taurus
tgccacgctgacctccaccctcacactcctaggcctcagcttgctgatcctgggttgttgtctgcctgccccaggacactatgaacccattcaaagcagtracccaggcttggccagctctgtgtctccagggtttgactccagggcttctgttaatgtttgtggaacaaggcagctcccgggatctagacaactatgaat

SEQ ID NO: 116510 - DNA, 201 bp, Bos taurus; identical to SEQ ID NO: 35755

SEQ ID NO: 116511 - DNA, 201 bp, Bos taurus
ttgatccctggttggggaactaacttctcatatggtgtggtgaggccaaaagtatttaaaaaccaatctgactggtgcccttgaatagaggagcttgggakgcagacccagaggaaaggccacgtgaggacacagggagatggctgtcgatgggccaagaaaggcctcggaaggagccaggcctgctgacaccttgacctc

SEQ ID NO: 116512 - DNA, 201 bp, Bos taurus; identical to SEQ ID NO: 35756

SEQ ID NO: 116513 - DNA, 201 bp, Bos taurus; identical to SEQ ID NO: 35757

SEQ ID NO: 116514 - DNA, 201 bp, Bos taurus
accctcagcactcacatgggctcagccccatcaggccatgctgggtggaataatgaatggttttggattcctcaaaccccacctgacagccagagtaccayggtgggggccctgggtgggttgtcttacatatgatcacggtttcctaattttccaccctgaggaacactacaggtccctctcttccggtggctggttgcc

SEQ ID NO: 116515 - DNA, 201 bp, Bos taurus
gggacatgcagggcgctctcctgaggggccttagtggcaggaggagtaggtgggttcccctgtccagtgggagagcgctgggcaggccgcctgcaaggcgkgactgaagctgctcccctgggttcactcactttgggttattctcagtggggagggggcaggacccaagctcagtgaactgggtgtcagccaaggccactt

SEQ ID NO: 116516 - DNA, 201 bp, Bos taurus
gccctggtcttgtccagagcgcggccaccacccgacgtacggcagggcagtgagtcccggatcggcgggcttcctgtctccccaccagcacacgctctgckcagggcccagtgtccccggtgcctggaccagcacgggtacccagcagggctgggattaatggcctcccggccccagcctcacccctcctccagacggctg

SEQ ID NO: 116517 - DNA, 201 bp, Bos taurus
caactccagaccttcatcttcagaaccgaaccccagggaggcggagagacaacgtgactgtctaattctttatttactgaattacagactccaccgtcccycagcccccggccctgaggtgcttagtgatgagctttccgagccgctgagcggctctctgaagggacatctcctgagcagcactgtgagaccagcagcaga

SEQ ID NO: 116518 - DNA, 201 bp, Bos taurus; identical to SEQ ID NO: 75207

SEQ ID NO: 116519 - DNA, 201 bp, Bos taurus; identical to SEQ ID NO: 75208

SEQ ID NO: 116520 - DNA, 201 bp, Bos taurus; identical to SEQ ID NO: 35758

SEQ ID NO: 116521 - DNA, 201 bp, Bos taurus; identical to SEQ ID NO: 75210

SEQ ID NO: 116522 - DNA, 201 bp, Bos taurus; identical to SEQ ID NO: 75211

SEQ ID NO: 116523 - DNA, 201 bp, Bos taurus; identical to SEQ ID NO: 35760

SEQ ID NO: 116524 - DNA, 201 bp, Bos taurus; identical to SEQ ID NO: 35762

SEQ ID NO: 116525 - DNA, 201 bp, Bos taurus; identical to SEQ ID NO: 35764

SEQ ID NO: 116526 - DNA, 201 bp, Bos taurus; identical to SEQ ID NO: 35766

SEQ ID NO: 116527 - DNA, 201 bp, Bos taurus; identical to SEQ ID NO: 35767

SEQ ID NO: 116528 - DNA, 201 bp, Bos taurus; identical to SEQ ID NO: 75215

SEQ ID NO: 116529 - DNA, 201 bp, Bos taurus; identical to SEQ ID NO: 35769

SEQ ID NO: 116530 - DNA, 201 bp, Bos taurus; identical to SEQ ID NO: 75217

SEQ ID NO: 116531 - DNA, 201 bp, Bos taurus; identical to SEQ ID NO: 75218

SEQ ID NO: 116532 - DNA, 201 bp, Bos taurus
cccttctgtctatttctccatctttgagcaaacaaaaacagctggcagattcaggaccacacctcacccagccaccgccaagttaatgtcacatctgtttytgtgcaggtgtcttccctttggccttgaatgttgacatgtcattgatggtttgcttttcggggaattaatttgagatgtccatgtttcttacaagggtat

SEQ ID NO: 116533 - DNA, 201 bp, Bos taurus; identical to SEQ ID NO: 75219

SEQ ID NO: 116534 - DNA, 201 bp, Bos taurus
catcagataaattataaatatattttaaatcaaagactggtcccacaagggcagcactctctgtgttactcattgctgtacctgggatacgcactataacyactctcacactgaatatatatttgttgaatcaatatatgaagtctttcactagtactaatagcttgtagattctaattttttctgtgtagaacatacttt

SEQ ID NO: 116535 - DNA, 201 bp, Bos taurus
tgctaggaagcctacagggccaatggcatgtgatagaaacaaaggcttcattatttggttctaatagatctgcagtttgaaaggtacctcttctccaggtrataggttaggtaacggtgtggccacttctctccctgtgttcttaattctggaatcatcattagagtcaggtaaagtagaattaacctctaagatgaagtg

SEQ ID NO: 116536 - DNA, 201 bp, Bos taurus; identical to SEQ ID NO: 75220

SEQ ID NO: 116537 - DNA, 201 bp, Bos taurus
ggctggagcccactgaggttcttccctaccccaggagctggcctgcactgacgcctgcctgccggtcccctcaggggcttccctccacgcccacagcacayctgaacatcataccatggcctgcaatgcccatggggtccaccctgatcatctctgaccactgctacctcctcctgctctgtccgcatggacctccatgcc

SEQ ID NO: 116538 - DNA, 201 bp, Bos taurus
gccagaccgagcacctgcccagccccataccgcagctcaagtgcaagcgcacagtagcaggaaactggacttagctaaagctgggttttaccaggtgactrtgaaagtgggagaaagggccacgttttagaaagaagaggactgacaacacaagggtggcagggaacactggaaaggaagtggggctgagggtcccgggag

SEQ ID NO: 116539 - DNA, 201 bp, Bos taurus; identical to SEQ ID NO: 75222

SEQ ID NO: 116540 - DNA, 201 bp, Bos taurus; identical to SEQ ID NO: 75224

SEQ ID NO: 116541 - DNA, 201 bp, Bos taurus; identical to SEQ ID NO: 35773

SEQ ID NO: 116542 - DNA, 201 bp, Bos taurus
gagggaccaaggaagaaagaagccatcagaacaaaaggaggtggggagttatgatggcttgaagctccctacacaaaggctttcttctgcttaggcccatycttttttcagtcttcctttccggagaatttcccaaggaggcagctacaaacagacttgagatttctgagcatcttgaataaagagaggaaatgcagatga

SEQ ID NO: 116543 - DNA, 201 bp, Bos taurus; identical to SEQ ID NO: 75228

SEQ ID NO: 116544 - DNA, 201 bp, Bos taurus
cacattttcctgcttcagtcaaatccctggtcaaaactctgtgacctcggcacctataaaaacaacccaatcaaagtgttgagattgctttcctcgaaacyatcatcctctcccccagccctgcagtaggtaatgaagtcctaaaagtcctaaaaccaagcattgtgatgagatgcattccagcagcttaggcggaattcc

SEQ ID NO: 116545 - DNA, 201 bp, Bos taurus; identical to SEQ ID NO: 35775

SEQ ID NO: 116546 - DNA, 201 bp, Bos taurus; identical to SEQ ID NO: 35776

SEQ ID NO: 116547 - DNA, 201 bp, Bos taurus
tcttagaaagcatctccatattgagctcattgccaatttgagatcatatcttgctcacatgtgtttcatgaggatttaatgaattatatgaaaaagtgtgycatctagtcagcccaaaggtgttcatctgatgacagttacttctactgtgtctccctatttttccattcctctaccttaccattttcccctcctctagaa

SEQ ID NO: 116548 - DNA, 201 bp, Bos taurus; identical to SEQ ID NO: 75234

SEQ ID NO: 116549 - DNA, 201 bp, Bos taurus; identical to SEQ ID NO: 35777

SEQ ID NO: 116550 - DNA, 201 bp, Bos taurus; identical to SEQ ID NO: 35778

SEQ ID NO: 116551 - DNA, 201 bp, Bos taurus; identical to SEQ ID NO: 35780

SEQ ID NO: 116552 - DNA, 201 bp, Bos taurus; identical to SEQ ID NO: 75235

SEQ ID NO: 116553 - DNA, 201 bp, Bos taurus; identical to SEQ ID NO: 75237

SEQ ID NO: 116554 - DNA, 201 bp, Bos taurus
tgtccatccatcagtttccatcacttaaaagctcagaaacctttctgccttttatttccagatctgaaatgccagtcccctctgtttgagctcttgactgyggccatgttggccatctcctctgcagagtcctagttgttgtatctaatacctccagaaccttccttaacaggatgttggaggtcctcacctaaattcaaa

SEQ ID NO: 116555 - DNA, 201 bp, Bos taurus
tgctatcaaacggcagttgttccttcttgcctgagggtatgtgttctttcccacggttatgaacaagcaagatacagattcagtttagcaaatgcatggtrtatttaaatattgctttatcatatttctgagccaactgccaagttagccagttttctggagaggactccctctagtgaccaacagactataatggtgagt

SEQ ID NO: 116556 - DNA, 201 bp, Bos taurus; identical to SEQ ID NO: 75238

SEQ ID NO: 116557 - DNA, 201 bp, Bos taurus; identical to SEQ ID NO: 75239

SEQ ID NO: 116558 - DNA, 201 bp, Bos taurus
ggttgggtaggctcctaaggacagatactctcttccagctgtggcctgtctaggcctccatgttgtcaactcaccagctggccacgtgactgctgggagaygtggacatgagccggtaagccccaaagtgtgactgacacgaagtcccagagaagagagggactctttgacctctgccagtctctgcctggccctcggcgt

SEQ ID NO: 116559 - DNA, 201 bp, Bos taurus
gcagtttctgaatgaacacatgaatgaaggagaggcaacagagcctagacatgaggagcacggggtccgaagccagtgtgtctgagctctcactcagcgcyaccactcgccagctgtgtaaacttgcacgtttcacttcacctctctgcacctcagttttctcctctataaacagtgcctacatctcacacttgtgatgag

SEQ ID NO: 116560 - DNA, 201 bp, Bos taurus
tcttccatggcccagaaatgatggctgagaaaccccactggacgtggcagaaggctctgtactcagagtgaggctcagacatgctgatggcccccagcccyccgactgtggggaccccccaggggactgcggtcctgtccatctgcccgcaggagcggtaagcagcaccagtggccagccggcccctgcatttctgctgtc

SEQ ID NO: 116561 - DNA, 201 bp, Bos taurus; identical to SEQ ID NO: 75250

SEQ ID NO: 116562 - DNA, 201 bp, Bos taurus
ggacccccagttttgacttcctgagcagggcagggtcatgtccccccaaaacctcaggaggtgggaattcgtccactagatgccaatcttggtcaactgcyttcacagatgcctcaggacctgagcaagccccaccctttcctccaacccttctccctcagagccaggaaggacacagagagaccagagctgggcgtccat

SEQ ID NO: 116563 - DNA, 201 bp, Bos taurus; identical to SEQ ID NO: 75251

SEQ ID NO: 116564 - DNA, 201 bp, Bos taurus; identical to SEQ ID NO: 75252

SEQ ID NO: 116565 - DNA, 201 bp, Bos taurus
aatatgcagctaaagttcagtttaattctcagataaggttttcttggacacataccattttcttctcatgtaaataaaaatcagtctacttggtttttaayacttgccactttacaaaataaatcaaaatgttgcagagtacttatttcttttctttagtgcttttataaggcatttgtgttaccactaaatatatggatt

SEQ ID NO: 116566 - DNA, 201 bp, Bos taurus
ctggcagggtatctgggctcctgacatgcagtgagcccctgcattacccagcctgctttgcagctgagtggggcccacgtgactagttctggccaatgaayagagcagcacctgtcacttcaggtctgaggcagttaagacctcgtgtgtttgtcaccactttcctttcctgccctggtgaccttagaggccacacgtcca

SEQ ID NO: 116567 - DNA, 201 bp, Bos taurus; identical to SEQ ID NO: 75259

SEQ ID NO: 116568 - DNA, 201 bp, Bos taurus; identical to SEQ ID NO: 75260

SEQ ID NO: 116569 - DNA, 201 bp, Bos taurus
ccgggccccgtgcctgctgccataatggctggtgctctgctggtaatggattgagccaccacactgttctccttctaaaccagccctgcacacattcactrcagacctcaggccctgagcctttggtacaaactcctggtctgctctggttcattcctgaaaacacttgattaccgctcccttcatttgcagtcccttcct

SEQ ID NO: 116570 - DNA, 201 bp, Bos taurus; identical to SEQ ID NO: 75261

SEQ ID NO: 116571 - DNA, 201 bp, Bos taurus; identical to SEQ ID NO: 75262

SEQ ID NO: 116572 - DNA, 201 bp, Bos taurus; identical to SEQ ID NO: 75263

SEQ ID NO: 116573 - DNA, 201 bp, Bos taurus; identical to SEQ ID NO: 75264

SEQ ID NO: 116574 - DNA, 201 bp, Bos taurus
tctgtggctacactcgctccccctctcagcttgccggccctgcctgggagacacaggctctgtgttggacgcagcccttctgtgaggtctctggggcctcrgttggtatcaaggtggtcccccgagctgcagctgcaccctgcgtccctccgatgcccccacacccacttctccactccccgggaagcggccgtgccagca

SEQ ID NO: 116575 - DNA, 201 bp, Bos taurus
tgttctactctgtcctcagtgcctttcccaacccctctgcttcagtacagcactgcagcctccaggccccctgatggaccctctgacgaaagggccctgcrggaatcagatggcacagaccctcatgtggaaagccaagtcctctctgtcctttggcatccagcccctgcagacgtggccggctaaagaccctgaagtaga

SEQ ID NO: 116576 - DNA, 201 bp, Bos taurus; identical to SEQ ID NO: 75266

SEQ ID NO: 116577 - DNA, 201 bp, Bos taurus; identical to SEQ ID NO: 75267

SEQ ID NO: 116578 - DNA, 201 bp, Bos taurus; identical to SEQ ID NO: 75268

SEQ ID NO: 116579 - DNA, 201 bp, Bos taurus; identical to SEQ ID NO: 75275

SEQ ID NO: 116580 - DNA, 201 bp, Bos taurus
gccccaagagccagagactcccaggcttcctacttggaagctcccccaggactttggacatgtacagaatgagctgaatgaattcaggtctcacttcgagsgtcagaatgttagtctgcttttgttttttcatgttttgttctttgaatcaatgctgttgatgacaagctgtctttaataaattgtgttctttgcagtagg

SEQ ID NO: 116581 - DNA, 201 bp, Bos taurus
ctctcctgccatgaatttgcccagaccctcagcgctcagcccagctcttccgctagctgtatgtcccttgcttgtgaaatctcccttaaccagcctgggcragccctccaggagccccgtttggtgtggagccaccctcagggagctgccggtcatttagaggagccgtcaagagtccagaacaccagtctgctgagcacc

SEQ ID NO: 116582 - DNA, 201 bp, Bos taurus
gcaaaacaggggtgattctggcctcacagagctcacttggggaggctgacattccttaaataatttcacattttaggaccaagagaagtggtatgggggtkggggagcgtacggggccatgaaggccaaccgttcccatgtggaccgcaggtggggatgtccgggaagacatctttttaaattatttgtttatttttggct

SEQ ID NO: 116583 - DNA, 201 bp, Bos taurus; identical to SEQ ID NO: 35782

SEQ ID NO: 116584 - DNA, 201 bp, Bos taurus; identical to SEQ ID NO: 35783

SEQ ID NO: 116585 - DNA, 201 bp, Bos taurus; identical to SEQ ID NO: 35784

SEQ ID NO: 116586 - DNA, 201 bp, Bos taurus; identical to SEQ ID NO: 35785

SEQ ID NO: 116587 - DNA, 201 bp, Bos taurus; identical to SEQ ID NO: 35786

SEQ ID NO: 116588 - DNA, 201 bp, Bos taurus; identical to SEQ ID NO: 35787

SEQ ID NO: 116589 - DNA, 201 bp, Bos taurus; identical to SEQ ID NO: 35788

SEQ ID NO: 116590 - DNA, 201 bp, Bos taurus; identical to SEQ ID NO: 35789

SEQ ID NO: 116591 - DNA, 201 bp, Bos taurus; identical to SEQ ID NO: 35790

SEQ ID NO: 116592 - DNA, 201 bp, Bos taurus; identical to SEQ ID NO: 35791

SEQ ID NO: 116593 - DNA, 201 bp, Bos taurus; identical to SEQ ID NO: 35792

SEQ ID NO: 116594 - DNA, 201 bp, Bos taurus; identical to SEQ ID NO: 35793

SEQ ID NO: 116595 - DNA, 201 bp, Bos taurus; identical to SEQ ID NO: 35794

SEQ ID NO: 116596 - DNA, 201 bp, Bos taurus; identical to SEQ ID NO: 35795

SEQ ID NO: 116597 - DNA, 201 bp, Bos taurus; identical to SEQ ID NO: 35796

SEQ ID NO: 116598 - DNA, 201 bp, Bos taurus; identical to SEQ ID NO: 35797

SEQ ID NO: 116599 - DNA, 201 bp, Bos taurus; identical to SEQ ID NO: 35798

SEQ ID NO: 116600 - DNA, 201 bp, Bos taurus; identical to SEQ ID NO: 35799

SEQ ID NO: 116601 - DNA, 201 bp, Bos taurus; identical to SEQ ID NO: 35800

SEQ ID NO: 116602 - DNA, 201 bp, Bos taurus; identical to SEQ ID NO: 35801

SEQ ID NO: 116603 - DNA, 201 bp, Bos taurus; identical to SEQ ID NO: 35802

SEQ ID NO: 116604 - DNA, 201 bp, Bos taurus; identical to SEQ ID NO: 35803

SEQ ID NO: 116605 - DNA, 201 bp, Bos taurus; identical to SEQ ID NO: 35804

SEQ ID NO: 116606 - DNA, 201 bp, Bos taurus; identical to SEQ ID NO: 35805

SEQ ID NO: 116607 - DNA, 201 bp, Bos taurus; identical to SEQ ID NO: 35806

SEQ ID NO: 116608 - DNA, 201 bp, Bos taurus; identical to SEQ ID NO: 35807

SEQ ID NO: 116609 - DNA, 201 bp, Bos taurus; identical to SEQ ID NO: 35809

SEQ ID NO: 116610 - DNA, 201 bp, Bos taurus; identical to SEQ ID NO: 35812

SEQ ID NO: 116611 - DNA, 201 bp, Bos taurus
gtgtacacgtgtatcagcatgggcccaaagtcgcatacatgagagcgtgtgtacactcctgggcaagtgcggatgcctgcaagggggctcaccaggcaccygaggccttacattccggagtcctgagacccctgggagaggggaagacttggtcctcccagcgggccccccacccgctgctccaccccgcagggccgcacc

SEQ ID NO: 116612 - DNA, 201 bp, Bos taurus; identical to SEQ ID NO: 35813

SEQ ID NO: 116613 - DNA, 201 bp, Bos taurus; identical to SEQ ID NO: 35814

SEQ ID NO: 116614 - DNA, 201 bp, Bos taurus; identical to SEQ ID NO: 35815

SEQ ID NO: 116615 - DNA, 201 bp, Bos taurus; identical to SEQ ID NO: 35816

SEQ ID NO: 116616 - DNA, 201 bp, Bos taurus; identical to SEQ ID NO: 35817

SEQ ID NO: 116617 - DNA, 201 bp, Bos taurus; identical to SEQ ID NO: 35818

SEQ ID NO: 116618 - DNA, 201 bp, Bos taurus; identical to SEQ ID NO: 35819

SEQ ID NO: 116619 - DNA, 201 bp, Bos taurus; identical to SEQ ID NO: 35820

SEQ ID NO: 116620 - DNA, 201 bp, Bos taurus; identical to SEQ ID NO: 35821

SEQ ID NO: 116621 - DNA, 201 bp, Bos taurus; identical to SEQ ID NO: 35822

SEQ ID NO: 116622 - DNA, 201 bp, Bos taurus; identical to SEQ ID NO: 35823

SEQ ID NO: 116623 - DNA, 201 bp, Bos taurus; identical to SEQ ID NO: 35824

SEQ ID NO: 116624 - DNA, 201 bp, Bos taurus; identical to SEQ ID NO: 35825

SEQ ID NO: 116625 - DNA, 201 bp, Bos taurus; identical to SEQ ID NO: 35826

SEQ ID NO: 116626 - DNA, 201 bp, Bos taurus; identical to SEQ ID NO: 35827

SEQ ID NO: 116627 - DNA, 201 bp, Bos taurus; identical to SEQ ID NO: 35828

SEQ ID NO: 116628 - DNA, 201 bp, Bos taurus; identical to SEQ ID NO: 35830

SEQ ID NO: 116629 - DNA, 201 bp, Bos taurus; identical to SEQ ID NO: 35831

SEQ ID NO: 116630 - DNA, 201 bp, Bos taurus; identical to SEQ ID NO: 35832

SEQ ID NO: 116631 - DNA, 201 bp, Bos taurus; identical to SEQ ID NO: 35833

SEQ ID NO: 116632 - DNA, 201 bp, Bos taurus; identical to SEQ ID NO: 35834

SEQ ID NO: 116633 - DNA, 201 bp, Bos taurus; identical to SEQ ID NO: 35835

SEQ ID NO: 116634 - DNA, 201 bp, Bos taurus; identical to SEQ ID NO: 35836

SEQ ID NO: 116635 - DNA, 201 bp, Bos taurus; identical to SEQ ID NO: 35837

SEQ ID NO: 116636 - DNA, 201 bp, Bos taurus; identical to SEQ ID NO: 35838

SEQ ID NO: 116637 - DNA, 201 bp, Bos taurus; identical to SEQ ID NO: 35839

SEQ ID NO: 116638 - DNA, 201 bp, Bos taurus; identical to SEQ ID NO: 35840

SEQ ID NO: 116639 - DNA, 201 bp, Bos taurus; identical to SEQ ID NO: 35841

SEQ ID NO: 116640 - DNA, 201 bp, Bos taurus; identical to SEQ ID NO: 35842

SEQ ID NO: 116641 - DNA, 201 bp, Bos taurus; identical to SEQ ID NO: 35843

SEQ ID NO: 116642 - DNA, 201 bp, Bos taurus; identical to SEQ ID NO: 35844

SEQ ID NO: 116643 - DNA, 201 bp, Bos taurus
attgtacaatcaagtctcataagatggctactctcttgctctctgtacatcccttgcaagaactggccctgcctcactcttaccttattcacatgattttmttcctctcctaagctgaaagtttaatcagtaactacatgtatgatcagtccaactcccaccaacaattattctagccctggaactagaccagaatggctc

SEQ ID NO: 116644 - DNA, 201 bp, Bos taurus; identical to SEQ ID NO: 35846

SEQ ID NO: 116645 - DNA, 201 bp, Bos taurus; identical to SEQ ID NO: 35847

SEQ ID NO: 116646 - DNA, 201 bp, Bos taurus; identical to SEQ ID NO: 35848

SEQ ID NO: 116647 - DNA, 201 bp, Bos taurus; identical to SEQ ID NO: 75335

SEQ ID NO: 116648 - DNA, 201 bp, Bos taurus; identical to SEQ ID NO: 75336

SEQ ID NO: 116649 - DNA, 201 bp, Bos taurus; identical to SEQ ID NO: 35849

SEQ ID NO: 116650 - DNA, 201 bp, Bos taurus; identical to SEQ ID NO: 35850

SEQ ID NO: 116651 - DNA, 201 bp, Bos taurus; identical to SEQ ID NO: 75337

SEQ ID NO: 116652 - DNA, 201 bp, Bos taurus; identical to SEQ ID NO: 75338

SEQ ID NO: 116653 - DNA, 201 bp, Bos taurus; identical to SEQ ID NO: 35851

SEQ ID NO: 116654 - DNA, 201 bp, Bos taurus; identical to SEQ ID NO: 35852

SEQ ID NO: 116655 - DNA, 201 bp, Bos taurus; identical to SEQ ID NO: 75339

SEQ ID NO: 116656 - DNA, 201 bp, Bos taurus; identical to SEQ ID NO: 35853

SEQ ID NO: 116657 - DNA, 201 bp, Bos taurus
catggaagacagtttttccacggatggagggaaggcagtggtttggggatgattcatgattcacatgattacatgtgttgtgcagtttatttctattattmttatattgtggtatgtagtgagaagattaaacagctcactgtaatacagagtcagtgggagccctgagctcaggtggtaactcgagccctggggagtggc

SEQ ID NO: 116658 - DNA, 201 bp, Bos taurus; identical to SEQ ID NO: 75340

SEQ ID NO: 116659 - DNA, 201 bp, Bos taurus
ctgttaggattttttctcttaggatttctcgtccatttcctgcatcttctgccttcttcctcatttacactggcatctcttgttaccgtctgattactcartgtacactttgcaattgccttgtctgcagtatgttctattgctcaggattcccacataattagtgcacagtattattctccagaaaataaaaatgaggct

SEQ ID NO: 116660 - DNA, 201 bp, Bos taurus; identical to SEQ ID NO: 75341

SEQ ID NO: 116661 - DNA, 201 bp, Bos taurus; identical to SEQ ID NO: 35855

SEQ ID NO: 116662 - DNA, 201 bp, Bos taurus; identical to SEQ ID NO: 35856

SEQ ID NO: 116663 - DNA, 201 bp, Bos taurus; identical to SEQ ID NO: 35857

SEQ ID NO: 116664 - DNA, 201 bp, Bos taurus; identical to SEQ ID NO: 35858

SEQ ID NO: 116665 - DNA, 201 bp, Bos taurus; identical to SEQ ID NO: 35859

SEQ ID NO: 116666 - DNA, 201 bp, Bos taurus; identical to SEQ ID NO: 35865

SEQ ID NO: 116667 - DNA, 201 bp, Bos taurus; identical to SEQ ID NO: 35866

SEQ ID NO: 116668 - DNA, 201 bp, Bos taurus; identical to SEQ ID NO: 35867

SEQ ID NO: 116669 - DNA, 201 bp, Bos taurus; identical to SEQ ID NO: 75354

SEQ ID NO: 116670 - DNA, 201 bp, Bos taurus; identical to SEQ ID NO: 35868

SEQ ID NO: 116671 - DNA, 201 bp, Bos taurus; identical to SEQ ID NO: 35871

SEQ ID NO: 116672 - DNA, 201 bp, Bos taurus; identical to SEQ ID NO: 35872

SEQ ID NO: 116673 - DNA, 201 bp, Bos taurus; identical to SEQ ID NO: 35874

SEQ ID NO: 116674 - DNA, 201 bp, Bos taurus; identical to SEQ ID NO: 35875

SEQ ID NO: 116675 - DNA, 201 bp, Bos taurus; identical to SEQ ID NO: 35876

SEQ ID NO: 116676 - DNA, 201 bp, Bos taurus; identical to SEQ ID NO: 35878

SEQ ID NO: 116677 - DNA, 201 bp, Bos taurus; identical to SEQ ID NO: 35880

SEQ ID NO: 116678 - DNA, 201 bp, Bos taurus
ataatccttactatcactaaataaatcttaaagttgtaaatattatgcataaatgatatggagaaaacattatagagtatttgtgacgtctgtatgtacakttatcagagtctgagttggtatcctggttgtagttatttcactttaatcagttttatcagtctccttcatcatattttttttcataaagaaaactggcat

SEQ ID NO: 116679 - DNA, 201 bp, Bos taurus
ttggaaatctcttagaatacacatagatttttttatctctctcaaattgcagatgctcttgggctgagaaacatatcaagttaaatgaattattaatgcaytagcataaaatcgttaattgcttattttgcttccatgataaattcattttaaaaaaacacaccaaaaaatggaatttgggagatggggagaagaaaggga

SEQ ID NO: 116680 - DNA, 201 bp, Bos taurus; identical to SEQ ID NO: 35885

SEQ ID NO: 116681 - DNA, 201 bp, Bos taurus
atgaaaaggcttggcaaatcttaagaatttgaatttagtttcatgctaattgaggggcccataaagaattttaagaaggaaaacaatgtgtatttctttcyattttgaaaataaaagttagcttcaggagaatggaatgggggagcagtgtgggttgaaaatgaagagacaatcagcaggcatcactgtcaagaattaatt

SEQ ID NO: 116682 - DNA, 201 bp, Bos taurus; identical to SEQ ID NO: 35886

SEQ ID NO: 116683 - DNA, 201 bp, Bos taurus; identical to SEQ ID NO: 35887

SEQ ID NO: 116684 - DNA, 201 bp, Bos taurus; identical to SEQ ID NO: 35889

SEQ ID NO: 116685 - DNA, 201 bp, Bos taurus; identical to SEQ ID NO: 75366

SEQ ID NO: 116686 - DNA, 201 bp, Bos taurus; identical to SEQ ID NO: 35890

SEQ ID NO: 116687 - DNA, 201 bp, Bos taurus
gttccctgtcagcagagccagttgctccagaaatgtcccctggtgggctgtgtgcaccctcctgctttcactggacaatgataactataggtttgctagcrtacaggcctggcccctgacacagttggctgtaaagcctagttgcaactgttcaggtagtctcatgtgctgggtcatctcctggggcaggagctactttag

SEQ ID NO: 116688 - DNA, 201 bp, Bos taurus
aaatatttctggagggaaaacagcactgcatattttacttattcccctagattttgttcttcctctaggttccatctcaattttctttgttattttgatgmatctctaatgttttcactcaatatgtttaattttcattatttttcaatattgatttcagattttataataatggtgatcaagaggagatcagtttataca

SEQ ID NO: 116689 - DNA, 201 bp, Bos taurus
aacttcatggcgctggccagacccaggaagaaatgtgataatcctttgttctttcagttgaccatgtaggtcaggatattcctgtaaacctccaacaagamaaatgttactctttgttttgcagctgcaacggtgcacaaacacggccaagagaagttatcccaccttcgaagtcaggggcagaagacaggaggaccccat

SEQ ID NO: 116690 - DNA, 201 bp, Bos taurus
tgttttccttgaaacataataattgaaaattcctgctttttgtttaattatcattcaacacaaattaaaagaagcaaaaaaagatgaattaaaattacaarggccaacaaaagaaatgatggtgaaataattttcttatcctatttttatatatttaatatttgaaatatcaatatctactttgatactatctaatcaaag

SEQ ID NO: 116691 - DNA, 201 bp, Bos taurus; identical to SEQ ID NO: 35892

SEQ ID NO: 116692 - DNA, 201 bp, Bos taurus; identical to SEQ ID NO: 35893

SEQ ID NO: 116693 - DNA, 201 bp, Bos taurus; identical to SEQ ID NO: 35895

SEQ ID NO: 116694 - DNA, 201 bp, Bos taurus; identical to SEQ ID NO: 35898

SEQ ID NO: 116695 - DNA, 201 bp, Bos taurus; identical to SEQ ID NO: 35899

SEQ ID NO: 116696 - DNA, 201 bp, Bos taurus; identical to SEQ ID NO: 35903

SEQ ID NO: 116697 - DNA, 201 bp, Bos taurus; identical to SEQ ID NO: 75378

SEQ ID NO: 116698 - DNA, 201 bp, Bos taurus; identical to SEQ ID NO: 75379

SEQ ID NO: 116699 - DNA, 201 bp, Bos taurus; identical to SEQ ID NO: 35907

SEQ ID NO: 116700 - DNA, 201 bp, Bos taurus; identical to SEQ ID NO: 35910

SEQ ID NO: 116701 - DNA, 201 bp, Bos taurus; identical to SEQ ID NO: 75383

SEQ ID NO: 116702 - DNA, 201 bp, Bos taurus; identical to SEQ ID NO: 75384

SEQ ID NO: 116703 - DNA, 201 bp, Bos taurus; identical to SEQ ID NO: 75385

SEQ ID NO: 116704 - DNA, 201 bp, Bos taurus; identical to SEQ ID NO: 35911

SEQ ID NO: 116705 - DNA, 201 bp, Bos taurus; identical to SEQ ID NO: 75386

SEQ ID NO: 116706 - DNA, 201 bp, Bos taurus; identical to SEQ ID NO: 35912

SEQ ID NO: 116707 - DNA, 201 bp, Bos taurus; identical to SEQ ID NO: 35913

SEQ ID NO: 116708 - DNA, 201 bp, Bos taurus; identical to SEQ ID NO: 35914

SEQ ID NO: 116709 - DNA, 201 bp, Bos taurus; identical to SEQ ID NO: 75387

SEQ ID NO: 116710 - DNA, 201 bp, Bos taurus; identical to SEQ ID NO: 35917

SEQ ID NO: 116711 - DNA, 201 bp, Bos taurus; identical to SEQ ID NO: 35918

SEQ ID NO: 116712 - DNA, 201 bp, Bos taurus; identical to SEQ ID NO: 35919

SEQ ID NO: 116713 - DNA, 201 bp, Bos taurus; identical to SEQ ID NO: 35920

SEQ ID NO: 116714 - DNA, 201 bp, Bos taurus; identical to SEQ ID NO: 35921

SEQ ID NO: 116715 - DNA, 201 bp, Bos taurus; identical to SEQ ID NO: 35922

SEQ ID NO: 116716 - DNA, 201 bp, Bos taurus; identical to SEQ ID NO: 75391

SEQ ID NO: 116717 - DNA, 201 bp, Bos taurus; identical to SEQ ID NO: 35924

SEQ ID NO: 116718 - DNA, 201 bp, Bos taurus; identical to SEQ ID NO: 75393

SEQ ID NO: 116719 - DNA, 201 bp, Bos taurus; identical to SEQ ID NO: 75394

SEQ ID NO: 116720 - DNA, 201 bp, Bos taurus; identical to SEQ ID NO: 35926

SEQ ID NO: 116721 - DNA, 201 bp, Bos taurus; identical to SEQ ID NO: 35927

SEQ ID NO: 116722 - DNA, 201 bp, Bos taurus; identical to SEQ ID NO: 35928

SEQ ID NO: 116723 - DNA, 201 bp, Bos taurus; identical to SEQ ID NO: 35929

SEQ ID NO: 116724 - DNA, 201 bp, Bos taurus; identical to SEQ ID NO: 35930

SEQ ID NO: 116725 - DNA, 201 bp, Bos taurus; identical to SEQ ID NO: 35931

SEQ ID NO: 116726 - DNA, 201 bp, Bos taurus; identical to SEQ ID NO: 35932

SEQ ID NO: 116727 - DNA, 201 bp, Bos taurus; identical to SEQ ID NO: 35933

SEQ ID NO: 116728 - DNA, 201 bp, Bos taurus; identical to SEQ ID NO: 35934

SEQ ID NO: 116729 - DNA, 201 bp, Bos taurus; identical to SEQ ID NO: 35935

SEQ ID NO: 116730 - DNA, 201 bp, Bos taurus; identical to SEQ ID NO: 35936

SEQ ID NO: 116731 - DNA, 201 bp, Bos taurus; identical to SEQ ID NO: 35937

SEQ ID NO: 116732 - DNA, 201 bp, Bos taurus; identical to SEQ ID NO: 35939

SEQ ID NO: 116733 - DNA, 201 bp, Bos taurus
tcatccaccttgacccttctacttcaggtataaaagtagacagggggataaaacatgagcaaatcagcagaaatcactgctggagaacatttcaagacccmtgctttagggagaagtacattttttcttagaatattgattgtgcatctagagaaaaagaggtggagaggaaatgtgtaagacatctatctagggttgatc

SEQ ID NO: 116734 - DNA, 201 bp, Bos taurus; identical to SEQ ID NO: 75412

SEQ ID NO: 116735 - DNA, 201 bp, Bos taurus; identical to SEQ ID NO: 35946

SEQ ID NO: 116736 - DNA, 201 bp, Bos taurus; identical to SEQ ID NO: 35947

SEQ ID NO: 116737 - DNA, 201 bp, Bos taurus; identical to SEQ ID NO: 35948

SEQ ID NO: 116738 - DNA, 201 bp, Bos taurus; identical to SEQ ID NO: 35949

SEQ ID NO: 116739 - DNA, 201 bp, Bos taurus; identical to SEQ ID NO: 35950

SEQ ID NO: 116740 - DNA, 201 bp, Bos taurus; identical to SEQ ID NO: 35951

SEQ ID NO: 116741 - DNA, 201 bp, Bos taurus; identical to SEQ ID NO: 35952

SEQ ID NO: 116742 - DNA, 201 bp, Bos taurus; identical to SEQ ID NO: 35953

SEQ ID NO: 116743 - DNA, 201 bp, Bos taurus; identical to SEQ ID NO: 35954

SEQ ID NO: 116744 - DNA, 201 bp, Bos taurus; identical to SEQ ID NO: 35955

SEQ ID NO: 116745 - DNA, 201 bp, Bos taurus; identical to SEQ ID NO: 35957

SEQ ID NO: 116746 - DNA, 201 bp, Bos taurus; identical to SEQ ID NO: 35958

SEQ ID NO: 116747 - DNA, 201 bp, Bos taurus; identical to SEQ ID NO: 35959

SEQ ID NO: 116748 - DNA, 201 bp, Bos taurus; identical to SEQ ID NO: 35960

SEQ ID NO: 116749 - DNA, 201 bp, Bos taurus; identical to SEQ ID NO: 35961

SEQ ID NO: 116750 - DNA, 201 bp, Bos taurus; identical to SEQ ID NO: 35962

SEQ ID NO: 116751 - DNA, 201 bp, Bos taurus; identical to SEQ ID NO: 35963

SEQ ID NO: 116752 - DNA, 201 bp, Bos taurus; identical to SEQ ID NO: 35964

SEQ ID NO: 116753 - DNA, 201 bp, Bos taurus; identical to SEQ ID NO: 35966

SEQ ID NO: 116754 - DNA, 201 bp, Bos taurus; identical to SEQ ID NO: 35967

SEQ ID NO: 116755 - DNA, 201 bp, Bos taurus; identical to SEQ ID NO: 35968

SEQ ID NO: 116756 - DNA, 201 bp, Bos taurus; identical to SEQ ID NO: 75460

SEQ ID NO: 116757 - DNA, 201 bp, Bos taurus; identical to SEQ ID NO: 75461

SEQ ID NO: 116758 - DNA, 201 bp, Bos taurus; identical to SEQ ID NO: 75463

SEQ ID NO: 116759 - DNA, 201 bp, Bos taurus
cactgtgtgccttttatgttcttggagtcctggagttggaaacgacatcgaaagttcatcatgtttcagttcccacttggaacagaattctacctaaaccrtccagcttgtgtcgttgtcgctctcttctctgagtctccggctaggaggatggtcatccggatatgatggatgggagttggctggcaacctgcttataac

SEQ ID NO: 116760 - DNA, 201 bp, Bos taurus
acatacacaagcattctctctatgggttctcatactaaaaccaacatttatctgctatagcataagagagtttccatgtgagcaaatcctctgtgagaaaytgacccttatccattcttatgatgataaatgtgaaccataagaaatatataataatgtttacttctccagcattatcagagtttgaacagattcacataa

SEQ ID NO: 116761 - DNA, 201 bp, Bos taurus
aagagctacaaaagcctaggagaagctaaatcagattgaagtggaaaggtaaagaaggtttcctggaagtgacatgagaagagatttttaaagtatgtgtyagctagatggataatgagagaaaggcattagagatgaaggaagcaacaaggtaaaaaaaaaagctcagaagaaagaaaccacaggctgttttcagaaatg

SEQ ID NO: 116762 - DNA, 201 bp, Bos taurus
atttttttcccctgaagtcctgtctgttgcatcataatccctttaactcaacattttattttatataaagcactttgactagaaacaaaaatagagtttayataataatcaaatttggtggcacacaagtgaaggactggctctttagaatgttatctcaaagaaaatattttctatggtaaagtctcacttctaggtatg

SEQ ID NO: 116763 - DNA, 201 bp, Bos taurus; identical to SEQ ID NO: 75469

SEQ ID NO: 116764 - DNA, 201 bp, Bos taurus; identical to SEQ ID NO: 75470

SEQ ID NO: 116765 - DNA, 201 bp, Bos taurus
ctggagcctggtaattccactttttgctgaagctaaaaacaaaagcagatttccttagtttcttcctaatgtccatcttctctcccaagatgccatccagracatagcattttgtttagttctcacgcccctcagacctctcctggctgttagcgtttctcttcccttgtttttaatcctcgtatttttttttttttttgt

SEQ ID NO: 116766 - DNA, 201 bp, Bos taurus; identical to SEQ ID NO: 75478

SEQ ID NO: 116767 - DNA, 201 bp, Bos taurus; identical to SEQ ID NO: 75479

SEQ ID NO: 116768 - DNA, 201 bp, Bos taurus; identical to SEQ ID NO: 75480

SEQ ID NO: 116769 - DNA, 201 bp, Bos taurus
agtatattaccctgagggaacagtgtaccaagaaaaataaaggctgactgcagaatatgctaaacttgtggccaagaaaatggaggaggccaaagaaaaaygccagaaagagactaccaagagagggaggctgtcctctccaagagcttccacctctgaggccagtcaaaactaagatgtgagttggttccaggacagagg

SEQ ID NO: 116770 - DNA, 201 bp, Bos taurus
caaggtatccaatgtttgattgaactccctgagatcttgctctctgtgcaggctcctagtgctgttgtgaaactggactcacctttggcctagaatggaaygatttcagacaagagatgataagtattagggctgaaacacagatggctgcagaggagactctggcatctggcaaatctttgctttcttagggcccttcag

SEQ ID NO: 116771 - DNA, 201 bp, Bos taurus; identical to SEQ ID NO: 35977

SEQ ID NO: 116772 - DNA, 201 bp, Bos taurus; identical to SEQ ID NO: 35978

SEQ ID NO: 116773 - DNA, 201 bp, Bos taurus; identical to SEQ ID NO: 35979

SEQ ID NO: 116774 - DNA, 201 bp, Bos taurus; identical to SEQ ID NO: 35981

SEQ ID NO: 116775 - DNA, 201 bp, Bos taurus; identical to SEQ ID NO: 35982

SEQ ID NO: 116776 - DNA, 201 bp, Bos taurus
gctcctgccacggagctgagagagccgggaactcttctcgattctccatcttgcccatcaaattaagtgacaatgaacggggctatcattcccatgcactraattctctccagaatctttttttatttatgtcctatctttcccattaattaaattttaatagcagttttttcctccagagtttccaccatatggatgaac

SEQ ID NO: 116777 - DNA, 201 bp, Bos taurus; identical to SEQ ID NO: 35985

SEQ ID NO: 116778 - DNA, 201 bp, Bos taurus; identical to SEQ ID NO: 35989

SEQ ID NO: 116779 - DNA, 201 bp, Bos taurus; identical to SEQ ID NO: 35990

SEQ ID NO: 116780 - DNA, 201 bp, Bos taurus; identical to SEQ ID NO: 35991

SEQ ID NO: 116781 - DNA, 201 bp, Bos taurus; identical to SEQ ID NO: 35992

SEQ ID NO: 116782 - DNA, 201 bp, Bos taurus; identical to SEQ ID NO: 35993

SEQ ID NO: 116783 - DNA, 201 bp, Bos taurus; identical to SEQ ID NO: 35994

SEQ ID NO: 116784 - DNA, 201 bp, Bos taurus
gctccacctggaggacaggcgctcccttctgctgattgctgtttccagacattggaatgaatgaatcaagtccatggcctgattttctgacctgaaaacargcaggaagagaatacttatgtgaatggtcatatctttgaggacagtgactgcaggagctggaggagagtttctgatggctgggccagccctgcttctctg

SEQ ID NO: 116785 - DNA, 201 bp, Bos taurus
gagaattccttctaaatcaacagccagtggtcaaagtaaacactgggctgaagattacttttgagaaactgcttacaacaactgcaaagtcattaacaaarcaaggagctggggtgcaaccacaatggaaggcctgaaggaatgtgttgaacaacgtcgcgtaagtcaagcatctgtggccaggatccagtgtttggcgag

SEQ ID NO: 116786 - DNA, 201 bp, Bos taurus; identical to SEQ ID NO: 35997

SEQ ID NO: 116787 - DNA, 201 bp, Bos taurus; identical to SEQ ID NO: 35998

SEQ ID NO: 116788 - DNA, 201 bp, Bos taurus
aataaagaaccttcaactactctgaacctcctgccctcattctgcagaagtgacaagttgtttcatcatcatctgccttgattgtcctgggcaccagaaayaatgtcgtcactcattcattcatcaaatatttactgcaaccccgcgccccccgccagcctatatgaaagcactgggctagcagcactggagtgcaaagtc

SEQ ID NO: 116789 - DNA, 201 bp, Bos taurus; identical to SEQ ID NO: 35999

SEQ ID NO: 116790 - DNA, 201 bp, Bos taurus; identical to SEQ ID NO: 36002

SEQ ID NO: 116791 - DNA, 201 bp, Bos taurus
acatatgactgtgtgccaggatcgggccagggtctgtaatgtgctgtcttgtccaggtctcatcgtcatgctagaaagttattattattcccgttttgccracaagaaacagcaggtccagcttcctgaaccaggtggcgtggtggcagagtgatggcagacaggagacaagcatgtgtaagttcccaaatctcaacagga

SEQ ID NO: 116792 - DNA, 201 bp, Bos taurus; identical to SEQ ID NO: 36003

SEQ ID NO: 116793 - DNA, 201 bp, Bos taurus; identical to SEQ ID NO: 36004

SEQ ID NO: 116794 - DNA, 201 bp, Bos taurus; identical to SEQ ID NO: 36005

SEQ ID NO: 116795 - DNA, 201 bp, Bos taurus; identical to SEQ ID NO: 36006

SEQ ID NO: 116796 - DNA, 201 bp, Bos taurus; identical to SEQ ID NO: 36007

SEQ ID NO: 116797 - DNA, 201 bp, Bos taurus; identical to SEQ ID NO: 36008

SEQ ID NO: 116798 - DNA, 201 bp, Bos taurus; identical to SEQ ID NO: 36009

SEQ ID NO: 116799 - DNA, 201 bp, Bos taurus; identical to SEQ ID NO: 36010

SEQ ID NO: 116800 - DNA, 201 bp, Bos taurus; identical to SEQ ID NO: 36011

SEQ ID NO: 116801 - DNA, 201 bp, Bos taurus; identical to SEQ ID NO: 36012

SEQ ID NO: 116802 - DNA, 201 bp, Bos taurus; identical to SEQ ID NO: 36013

SEQ ID NO: 116803 - DNA, 201 bp, Bos taurus; identical to SEQ ID NO: 36014

SEQ ID NO: 116804 - DNA, 201 bp, Bos taurus; identical to SEQ ID NO: 36015

SEQ ID NO: 116805 - DNA, 201 bp, Bos taurus; identical to SEQ ID NO: 36016

SEQ ID NO: 116806 - DNA, 201 bp, Bos taurus; identical to SEQ ID NO: 36017

SEQ ID NO: 116807 - DNA, 201 bp, Bos taurus; identical to SEQ ID NO: 36018

SEQ ID NO: 116808 - DNA, 201 bp, Bos taurus; identical to SEQ ID NO: 36019

SEQ ID NO: 116809 - DNA, 201 bp, Bos taurus; identical to SEQ ID NO: 36020

SEQ ID NO: 116810 - DNA, 201 bp, Bos taurus; identical to SEQ ID NO: 36021

SEQ ID NO: 116811 - DNA, 201 bp, Bos taurus; identical to SEQ ID NO: 36022

SEQ ID NO: 116812 - DNA, 201 bp, Bos taurus; identical to SEQ ID NO: 36023

SEQ ID NO: 116813 - DNA, 201 bp, Bos taurus; identical to SEQ ID NO: 36024

SEQ ID NO: 116814 - DNA, 201 bp, Bos taurus; identical to SEQ ID NO: 36025

SEQ ID NO: 116815 - DNA, 201 bp, Bos taurus; identical to SEQ ID NO: 36026

SEQ ID NO: 116816 - DNA, 201 bp, Bos taurus; identical to SEQ ID NO: 36027

SEQ ID NO: 116817 - DNA, 201 bp, Bos taurus; identical to SEQ ID NO: 36028

SEQ ID NO: 116818 - DNA, 201 bp, Bos taurus; identical to SEQ ID NO: 36029

SEQ ID NO: 116819 - DNA, 201 bp, Bos taurus; identical to SEQ ID NO: 36030

SEQ ID NO: 116820 - DNA, 201 bp, Bos taurus; identical to SEQ ID NO: 36031

SEQ ID NO: 116821 - DNA, 201 bp, Bos taurus; identical to SEQ ID NO: 36032

SEQ ID NO: 116822 - DNA, 201 bp, Bos taurus; identical to SEQ ID NO: 36033

SEQ ID NO: 116823 - DNA, 201 bp, Bos taurus; identical to SEQ ID NO: 36034

SEQ ID NO: 116824 - DNA, 201 bp, Bos taurus; identical to SEQ ID NO: 36035

SEQ ID NO: 116825 - DNA, 201 bp, Bos taurus; identical to SEQ ID NO: 36036

SEQ ID NO: 116826 - DNA, 201 bp, Bos taurus; identical to SEQ ID NO: 36037

SEQ ID NO: 116827 - DNA, 201 bp, Bos taurus; identical to SEQ ID NO: 36038

SEQ ID NO: 116828 - DNA, 201 bp, Bos taurus; identical to SEQ ID NO: 75537

SEQ ID NO: 116829 - DNA, 201 bp, Bos taurus; identical to SEQ ID NO: 75538

SEQ ID NO: 116830 - DNA, 201 bp, Bos taurus; identical to SEQ ID NO: 75541

SEQ ID NO: 116831 - DNA, 201 bp, Bos taurus; identical to SEQ ID NO: 75542

SEQ ID NO: 116832 - DNA, 201 bp, Bos taurus; identical to SEQ ID NO: 75543

SEQ ID NO: 116833 - DNA, 201 bp, Bos taurus; identical to SEQ ID NO: 75544

SEQ ID NO: 116834 - DNA, 201 bp, Bos taurus; identical to SEQ ID NO: 75545

SEQ ID NO: 116835 - DNA, 201 bp, Bos taurus; identical to SEQ ID NO: 36047

SEQ ID NO: 116836 - DNA, 201 bp, Bos taurus
tccaaattctggtccttctttagtccttgggcatgtaaacctttactcaccactgggtgtcagtcagtgtgccacgtcggggctggccaaaggacctgttrgattttctgggaagggggtacagggaagactggagctgaggttggaggatgatcatgaactgaggactccttggcctcactgttgctgctggctgtcctg

SEQ ID NO: 116837 - DNA, 201 bp, Bos taurus
atcacgttttaaaactcaatgagtttccagttttattagcctcacttctttcttaggtcatgtgaatctattgaactctagactgttgttgaatatatatrcagtgctgcaatttttagtttataagacatttgggattgttatatatcctgcattattttatgaggaaaataagtttcagttgacagattatatggaaga

SEQ ID NO: 116838 - DNA, 201 bp, Bos taurus; identical to SEQ ID NO: 36051

SEQ ID NO: 116839 - DNA, 201 bp, Bos taurus; identical to SEQ ID NO: 75560

SEQ ID NO: 116840 - DNA, 201 bp, Bos taurus; identical to SEQ ID NO: 36052

SEQ ID NO: 116841 - DNA, 201 bp, Bos taurus; identical to SEQ ID NO: 36053

SEQ ID NO: 116842 - DNA, 201 bp, Bos taurus
tgtactttacagacacaaagatgtggctaataaaatttatgttgtcctagaatataggctctttcttcttttccataattcagtgaacactcttgctcctyctattcccagtccctctatgtacatctggcagtttatattttcataagccaatagagtgttttccttcatgtatttacgccttttgtctgtaatgtctct

SEQ ID NO: 116843 - DNA, 201 bp, Bos taurus; identical to SEQ ID NO: 36056

SEQ ID NO: 116844 - DNA, 201 bp, Bos taurus
acttgtttttattatttttacaacccaggaagatgctttggtgtccataggccaaacttcaacttgccataacccctatcccacaggcctctgtgcttgartttgtcctgatcctagaagttactgaaaacactttaataaaatcataatgaaaaaggccttaaaacacaagtggtacagtgaaaatgcttcctttccttg

SEQ ID NO: 116845 - DNA, 201 bp, Bos taurus
agaaagcttgttgtaaattgttctaataaatttgaaaagttgagcttccgaccaaagatagacatctttgcatttagtctttctaactattgacataatgrctaatgtagcaatgtgagaaaattttccctttttcattaaatccaaaatttttcatcccatatagaagagagaaactttctccaaatatgttctacaatt

SEQ ID NO: 116846 - DNA, 201 bp, Bos taurus
ctggcccttcccagtttccagtgttcagtttcctgtttggaagcttgggtcctgctcagaatatatcatcaatgtgtagacattcttcaggctggcagggrggattggtggcacactgaggcctccatctctacagggtctgattgatgacagtaatctgaattttcctcatctgtaaagtgggacacttaatctgtattg

SEQ ID NO: 116847 - DNA, 201 bp, Bos taurus; identical to SEQ ID NO: 36057

SEQ ID NO: 116848 - DNA, 201 bp, Bos taurus; identical to SEQ ID NO: 36058

SEQ ID NO: 116849 - DNA, 201 bp, Bos taurus; identical to SEQ ID NO: 36060

SEQ ID NO: 116850 - DNA, 201 bp, Bos taurus
gcatataatatcagaaaccaacagtaattaaaagtaatcaaatttagtgaaatatgtacaaaataaagagatctgtacacattttaaggagttatcaatcratatactgtttactatgtgaaatgagacaatgcttattactaaaataaaggctaagtctcttctttgcctcattttctgcttttgtaaaatgtattgctt

SEQ ID NO: 116851 - DNA, 201 bp, Bos taurus; identical to SEQ ID NO: 36061

SEQ ID NO: 116852 - DNA, 201 bp, Bos taurus; identical to SEQ ID NO: 36062

SEQ ID NO: 116853 - DNA, 201 bp, Bos taurus; identical to SEQ ID NO: 36063

SEQ ID NO: 116854 - DNA, 201 bp, Bos taurus
cttacttgtttttataaaaacctaagcaagcatggtgtaggcaaggcgaggtggggcagtggggaagtggctataagctttggaccagctgactacattcygctgaaggtaaatgatcagctttcaaatatcctatgccatgtaggaatgcacatgcccagattaaagtatagtgcagacctggggaagagttcagagatg

SEQ ID NO: 116855 - DNA, 201 bp, Bos taurus
gacagttcctgttagcacatagtaaaagccatacaggtattagccatatgattgtaagtaactaaataaggaaagcagtccaagaaggccccacagagaamgttgttattgttcagtcggtaagtcgtgtccaactttttacagagaaaatagcattggcttaatggcctgagatagtgacatgagcactatctgggaagc

SEQ ID NO: 116856 - DNA, 201 bp, Bos taurus; identical to SEQ ID NO: 36065

SEQ ID NO: 116857 - DNA, 201 bp, Bos taurus
ccagtattcttgcctggaaaatcccatggatggaggaatccatggggtcagaaaagagtcagatatgactgagagacttcactgtgccaagaatggtgctrggcacttttcatgaattagctttttttcagtcttcatcacaaatcattttagatatatattatttgcctcctttagaaacaagaagactgaggctcagag

SEQ ID NO: 116858 - DNA, 201 bp, Bos taurus; identical to SEQ ID NO: 36068

SEQ ID NO: 116859 - DNA, 201 bp, Bos taurus
ccctaagattggtgtttttgagctgatccagcgcctttcattgtaataatcggttttatgcttttcttccccaagactgagttcttttctggtcacaattyatctcttccttctcaggacctgacatagttttcttcttgtgcctttgatcaacatgaaccattgtttcaagttggagtagagaaagctggattttttcaa

SEQ ID NO: 116860 - DNA, 201 bp, Bos taurus
ttcaatcacgaccaatttacagataatgttgtgctagtttctcgtgtgtgttgtcagtttcatcacctgtgccagattgtcaagtgaatgccctagataaygtggataccttagtcaacaagtttcatcatgcttctaagtggaaatgttctggaaattttcctctcagctcttttcacttgcttgtacctttctggatga

SEQ ID NO: 116861 - DNA, 201 bp, Bos taurus
agatctcctggattcaactaataggaatttttagggatagcaaacataggaagccacttttgtagtagttactacagtcttttacacaatacattctcaaycagtcttcactgaatctgaagaaggaggaggggaggggaagagggagggggagaaaaggaagacactttcatctttgatgaagaaacttcagttgcgagg

SEQ ID NO: 116862 - DNA, 201 bp, Bos taurus; identical to SEQ ID NO: 36074

SEQ ID NO: 116863 - DNA, 201 bp, Bos taurus; identical to SEQ ID NO: 36075

SEQ ID NO: 116864 - DNA, 201 bp, Bos taurus
tttttttttttaatggtaatttgttgtggaatatgcacacccagtgtatttgggaggacaatgggaaggttgtgttttctgctttgagactgaatcaaccmctgggatctggagaaggatgaagggctgtgaggttgcctgattttatcatccagtggcagcccacgttggaggagggaggagcgagctccggggttgggg

SEQ ID NO: 116865 - DNA, 201 bp, Bos taurus
agattctatcaccctagcttttcagtgaacactggcagaaattaaattactttgtcttgacctaaagcagaggctgatgctcagcactttccttttagagmcagagttcacatttagagatgttctaatttcctttttagagacgctgcttcttgtcggcaattccggttcctgacgaaagagctttgctgtgttgccggc

SEQ ID NO: 116866 - DNA, 201 bp, Bos taurus
agtgttcaatatgcattcaatatctacttatgtcgtaaagcatgtatatcaaagtaaatactgaaagtcatcagtgcacggaactgcagagagatacatamggaagtgctttcctgaatattttccatgctggggttcttcctttttcccttgatatgctttcattgtgcctcactgaaggataaaggagtagaacacaca

SEQ ID NO: 116867 - DNA, 201 bp, Bos taurus; identical to SEQ ID NO: 36079

SEQ ID NO: 116868 - DNA, 201 bp, Bos taurus
aaatttttgatataaaataaatatctaacatagcttcattacctacagagttaaacctaaaactgtaacaacatattcaagcctttccaggatctaccccyaacccatctcaccagctctttcttctacttctcagagtagtagttcccagattttaatgtgcttatgaatcacccggggagctggtgaaaatgcagaatc

SEQ ID NO: 116869 - DNA, 201 bp, Bos taurus
catccaggagagaagagagggacgttgaggtaaaccccacattcactaccctttttagttttgataaataaaccaaacaaaaactacagcttcaagtttayggcagtcacactgggcttggagatgaattctcaaggcaacctggacttgggaagtcaaaatccaggagaaaagagaactatagagaagtaaaccaatgtt

SEQ ID NO: 116870 - DNA, 201 bp, Bos taurus; identical to SEQ ID NO: 36080

SEQ ID NO: 116871 - DNA, 201 bp, Bos taurus; identical to SEQ ID NO: 36081

SEQ ID NO: 116872 - DNA, 201 bp, Bos taurus; identical to SEQ ID NO: 36082

SEQ ID NO: 116873 - DNA, 201 bp, Bos taurus; identical to SEQ ID NO: 36086

SEQ ID NO: 116874 - DNA, 201 bp, Bos taurus
ccaggtagcaaaaacctcctattatctcttatgtggaggtgggagaattcatggctattgagagggtcgttttatagaaaaagtgttgggcttatgccggkgcaggccaataaatgtggtggctgagagagggcagatgatgaatatgaatgccatattttgaactttacttgaggaaataaaccataagaaaaaagaatt

SEQ ID NO: 116875 - DNA, 201 bp, Bos taurus; identical to SEQ ID NO: 36088

SEQ ID NO: 116876 - DNA, 201 bp, Bos taurus; identical to SEQ ID NO: 36089

SEQ ID NO: 116877 - DNA, 201 bp, Bos taurus; identical to SEQ ID NO: 36090

SEQ ID NO: 116878 - DNA, 201 bp, Bos taurus; identical to SEQ ID NO: 36091

SEQ ID NO: 116879 - DNA, 201 bp, Bos taurus; identical to SEQ ID NO: 36092

SEQ ID NO: 116880 - DNA, 201 bp, Bos taurus; identical to SEQ ID NO: 36093

SEQ ID NO: 116881 - DNA, 201 bp, Bos taurus; identical to SEQ ID NO: 36094

SEQ ID NO: 116882 - DNA, 201 bp, Bos taurus
tatatttgaagtgattgattttggagtcaaagtgatgaaactgttgcagataaatgatttgctcacaaaagcatattgaagaaattgaagaaatctgaaaytcagaattgaaaatacttttttttgttgttgggaaatagtgttttactattaagaaagtctgcttcatttgtaaagaaaagcaattttttgttgaaaatt

SEQ ID NO: 116883 - DNA, 201 bp, Bos taurus
tctggaggttagaagtctaagaccaagatggctaaagacccagggtctggtgagagcactcttcctagcttgcatatggccacctctcactgcatctccaygtggcagagaagagacggggtgatgcaagctctctcatggttttgaaggacaatcagcagctacagagtcaggcagaaaacgtcaggccaatgtgtgaca

SEQ ID NO: 116884 - DNA, 201 bp, Bos taurus; identical to SEQ ID NO: 36096

SEQ ID NO: 116885 - DNA, 201 bp, Bos taurus
gccaccctttagtcagtgattccagatccaaaaattggctcaggtccaagaacagagcaaggaattatgacttactggattgactaccttcagcttcctgyccctcctcaggccctctcattatagaagttaaatggcacatccattttgtccctagacccccatactctattaagcctgctccacaacttctgaaaatgt

SEQ ID NO: 116886 - DNA, 201 bp, Bos taurus
tgttggaagggctgaaggagaaggagccaggggtgactggaactattggattcaagaaaacaccagcatcagaatcaagaagaccctgccatcaacccagytggggcaacaaccgtagctgtcttatgactctcacaggcaagcaaggtttcagctgctgtaactccctctcagcattcacaactctgagcccatgttctc

SEQ ID NO: 116887 - DNA, 201 bp, Bos taurus; identical to SEQ ID NO: 36099

SEQ ID NO: 116888 - DNA, 201 bp, Bos taurus; identical to SEQ ID NO: 36102

SEQ ID NO: 116889 - DNA, 201 bp, Bos taurus; identical to SEQ ID NO: 36103

SEQ ID NO: 116890 - DNA, 201 bp, Bos taurus; identical to SEQ ID NO: 36104

SEQ ID NO: 116891 - DNA, 201 bp, Bos taurus; identical to SEQ ID NO: 36105

SEQ ID NO: 116892 - DNA, 201 bp, Bos taurus
tgtaagctggttcaggagagaatggtaggagtggatggagggatggacccacatgccatcgagtcctgttcatctaagttaaacagctgttaaaattttartatctttgagcattcttctctttaaagtctataaaactcaaaggtatcagactctacaaaaggagttcttatgctattaatactcagtctgcaactctcc

SEQ ID NO: 116893 - DNA, 201 bp, Bos taurus; identical to SEQ ID NO: 36106

SEQ ID NO: 116894 - DNA, 201 bp, Bos taurus; identical to SEQ ID NO: 36107

SEQ ID NO: 116895 - DNA, 201 bp, Bos taurus; identical to SEQ ID NO: 36108

SEQ ID NO: 116896 - DNA, 201 bp, Bos taurus
tcagactttgttttcttaaagttgttgaaaccctggactgttctagacccagacagggcaggccctggtcattttcagtgtccatgtttaagagaaagccrtgctctttgcttgatggaggatattggccgaaccctgagactttgctttctttaggatgtgttggttcctggtgtccattgttcgggctcttctccagga

SEQ ID NO: 116897 - DNA, 201 bp, Bos taurus; identical to SEQ ID NO: 36110

SEQ ID NO: 116898 - DNA, 201 bp, Bos taurus; identical to SEQ ID NO: 36111

SEQ ID NO: 116899 - DNA, 201 bp, Bos taurus; identical to SEQ ID NO: 36112

SEQ ID NO: 116900 - DNA, 201 bp, Bos taurus; identical to SEQ ID NO: 36113

SEQ ID NO: 116901 - DNA, 201 bp, Bos taurus; identical to SEQ ID NO: 36114

SEQ ID NO: 116902 - DNA, 201 bp, Bos taurus; identical to SEQ ID NO: 36115

SEQ ID NO: 116903 - DNA, 201 bp, Bos taurus; identical to SEQ ID NO: 36116

SEQ ID NO: 116904 - DNA, 201 bp, Bos taurus; identical to SEQ ID NO: 36117

SEQ ID NO: 116905 - DNA, 201 bp, Bos taurus; identical to SEQ ID NO: 36118

SEQ ID NO: 116906 - DNA, 201 bp, Bos taurus; identical to SEQ ID NO: 36119

SEQ ID NO: 116907 - DNA, 201 bp, Bos taurus; identical to SEQ ID NO: 36120

SEQ ID NO: 116908 - DNA, 201 bp, Bos taurus; identical to SEQ ID NO: 36121

SEQ ID NO: 116909 - DNA, 201 bp, Bos taurus; identical to SEQ ID NO: 36122

SEQ ID NO: 116910 - DNA, 201 bp, Bos taurus; identical to SEQ ID NO: 36123

SEQ ID NO: 116911 - DNA, 201 bp, Bos taurus; identical to SEQ ID NO: 36124

SEQ ID NO: 116912 - DNA, 201 bp, Bos taurus; identical to SEQ ID NO: 36125

SEQ ID NO: 116913 - DNA, 201 bp, Bos taurus; identical to SEQ ID NO: 36126

SEQ ID NO: 116914 - DNA, 201 bp, Bos taurus; identical to SEQ ID NO: 36127

SEQ ID NO: 116915 - DNA, 201 bp, Bos taurus; identical to SEQ ID NO: 36128

SEQ ID NO: 116916 - DNA, 201 bp, Bos taurus; identical to SEQ ID NO: 36129

SEQ ID NO: 116917 - DNA, 201 bp, Bos taurus; identical to SEQ ID NO: 36130

SEQ ID NO: 116918 - DNA, 201 bp, Bos taurus; identical to SEQ ID NO: 36131

SEQ ID NO: 116919 - DNA, 201 bp, Bos taurus; identical to SEQ ID NO: 36132

SEQ ID NO: 116920 - DNA, 201 bp, Bos taurus; identical to SEQ ID NO: 36133

SEQ ID NO: 116921 - DNA, 201 bp, Bos taurus; identical to SEQ ID NO: 36134

SEQ ID NO: 116922 - DNA, 201 bp, Bos taurus; identical to SEQ ID NO: 36135

SEQ ID NO: 116923 - DNA, 201 bp, Bos taurus; identical to SEQ ID NO: 36136

SEQ ID NO: 116924 - DNA, 201 bp, Bos taurus; identical to SEQ ID NO: 36137

SEQ ID NO: 116925 - DNA, 201 bp, Bos taurus; identical to SEQ ID NO: 36138

SEQ ID NO: 116926 - DNA, 201 bp, Bos taurus; identical to SEQ ID NO: 36139

SEQ ID NO: 116927 - DNA, 201 bp, Bos taurus; identical to SEQ ID NO: 36140

SEQ ID NO: 116928 - DNA, 201 bp, Bos taurus; identical to SEQ ID NO: 36141

SEQ ID NO: 116929 - DNA, 201 bp, Bos taurus; identical to SEQ ID NO: 36142

SEQ ID NO: 116930 - DNA, 201 bp, Bos taurus; identical to SEQ ID NO: 36143

SEQ ID NO: 116931 - DNA, 201 bp, Bos taurus; identical to SEQ ID NO: 36144

SEQ ID NO: 116932 - DNA, 201 bp, Bos taurus; identical to SEQ ID NO: 36145

SEQ ID NO: 116933 - DNA, 201 bp, Bos taurus; identical to SEQ ID NO: 36146

SEQ ID NO: 116934 - DNA, 201 bp, Bos taurus; identical to SEQ ID NO: 36147

SEQ ID NO: 116935 - DNA, 201 bp, Bos taurus; identical to SEQ ID NO: 36148

SEQ ID NO: 116936 - DNA, 201 bp, Bos taurus; identical to SEQ ID NO: 36149

SEQ ID NO: 116937 - DNA, 201 bp, Bos taurus; identical to SEQ ID NO: 36150

SEQ ID NO: 116938 - DNA, 201 bp, Bos taurus; identical to SEQ ID NO: 36151

SEQ ID NO: 116939 - DNA, 201 bp, Bos taurus; identical to SEQ ID NO: 36152

SEQ ID NO: 116940 - DNA, 201 bp, Bos taurus; identical to SEQ ID NO: 36153

SEQ ID NO: 116941 - DNA, 201 bp, Bos taurus; identical to SEQ ID NO: 36154

SEQ ID NO: 116942 - DNA, 201 bp, Bos taurus; identical to SEQ ID NO: 36155

SEQ ID NO: 116943 - DNA, 201 bp, Bos taurus; identical to SEQ ID NO: 36156

SEQ ID NO: 116944 - DNA, 201 bp, Bos taurus; identical to SEQ ID NO: 36157

SEQ ID NO: 116945 - DNA, 201 bp, Bos taurus; identical to SEQ ID NO: 36158

SEQ ID NO: 116946 - DNA, 201 bp, Bos taurus; identical to SEQ ID NO: 36159

SEQ ID NO: 116947 - DNA, 201 bp, Bos taurus; identical to SEQ ID NO: 36160

SEQ ID NO: 116948 - DNA, 201 bp, Bos taurus; identical to SEQ ID NO: 36161

SEQ ID NO: 116949 - DNA, 201 bp, Bos taurus; identical to SEQ ID NO: 36162

SEQ ID NO: 116950 - DNA, 201 bp, Bos taurus; identical to SEQ ID NO: 36163

SEQ ID NO: 116951 - DNA, 201 bp, Bos taurus; identical to SEQ ID NO: 36164

SEQ ID NO: 116952 - DNA, 201 bp, Bos taurus; identical to SEQ ID NO: 36165

SEQ ID NO: 116953 - DNA, 201 bp, Bos taurus; identical to SEQ ID NO: 36166

SEQ ID NO: 116954 - DNA, 201 bp, Bos taurus; identical to SEQ ID NO: 36167

SEQ ID NO: 116955 - DNA, 201 bp, Bos taurus; identical to SEQ ID NO: 36168

SEQ ID NO: 116956 - DNA, 201 bp, Bos taurus; identical to SEQ ID NO: 36169

SEQ ID NO: 116957 - DNA, 201 bp, Bos taurus
aggagttttaaataggattgtctttaaacaaaactgtccatatatcctccatagtaaagtaacctcaattaactattaggttggtgtagaagtaataatgrtttcataccctgaattttacatcataatagctaggctcaatcacatctttattaatcaaaataggaaccattacaatcaacacatttttttttgccaatg

SEQ ID NO: 116958 - DNA, 201 bp, Bos taurus; identical to SEQ ID NO: 36170

SEQ ID NO: 116959 - DNA, 201 bp, Bos taurus; identical to SEQ ID NO: 36171

SEQ ID NO: 116960 - DNA, 201 bp, Bos taurus; identical to SEQ ID NO: 36172

SEQ ID NO: 116961 - DNA, 201 bp, Bos taurus; identical to SEQ ID NO: 36173

SEQ ID NO: 116962 - DNA, 201 bp, Bos taurus; identical to SEQ ID NO: 36174

SEQ ID NO: 116963 - DNA, 201 bp, Bos taurus; identical to SEQ ID NO: 36175

SEQ ID NO: 116964 - DNA, 201 bp, Bos taurus; identical to SEQ ID NO: 36176

SEQ ID NO: 116965 - DNA, 201 bp, Bos taurus; identical to SEQ ID NO: 36178

SEQ ID NO: 116966 - DNA, 201 bp, Bos taurus; identical to SEQ ID NO: 36179

SEQ ID NO: 116967 - DNA, 201 bp, Bos taurus; identical to SEQ ID NO: 36180

SEQ ID NO: 116968 - DNA, 201 bp, Bos taurus; identical to SEQ ID NO: 36181

SEQ ID NO: 116969 - DNA, 201 bp, Bos taurus; identical to SEQ ID NO: 36182

SEQ ID NO: 116970 - DNA, 201 bp, Bos taurus; identical to SEQ ID NO: 36183

SEQ ID NO: 116971 - DNA, 201 bp, Bos taurus; identical to SEQ ID NO: 36184

SEQ ID NO: 116972 - DNA, 201 bp, Bos taurus; identical to SEQ ID NO: 36185

SEQ ID NO: 116973 - DNA, 201 bp, Bos taurus; identical to SEQ ID NO: 36186

SEQ ID NO: 116974 - DNA, 201 bp, Bos taurus; identical to SEQ ID NO: 36187

SEQ ID NO: 116975 - DNA, 201 bp, Bos taurus; identical to SEQ ID NO: 36188

SEQ ID NO: 116976 - DNA, 201 bp, Bos taurus; identical to SEQ ID NO: 36189

SEQ ID NO: 116977 - DNA, 201 bp, Bos taurus; identical to SEQ ID NO: 36190

SEQ ID NO: 116978 - DNA, 201 bp, Bos taurus; identical to SEQ ID NO: 36191

SEQ ID NO: 116979 - DNA, 201 bp, Bos taurus; identical to SEQ ID NO: 36192

SEQ ID NO: 116980 - DNA, 201 bp, Bos taurus; identical to SEQ ID NO: 36193

SEQ ID NO: 116981 - DNA, 201 bp, Bos taurus; identical to SEQ ID NO: 36194

SEQ ID NO: 116982 - DNA, 201 bp, Bos taurus; identical to SEQ ID NO: 36195

SEQ ID NO: 116983 - DNA, 201 bp, Bos taurus; identical to SEQ ID NO: 36196

SEQ ID NO: 116984 - DNA, 201 bp, Bos taurus; identical to SEQ ID NO: 36197

SEQ ID NO: 116985 - DNA, 201 bp, Bos taurus; identical to SEQ ID NO: 36198

SEQ ID NO: 116986 - DNA, 201 bp, Bos taurus; identical to SEQ ID NO: 36200

SEQ ID NO: 116987 - DNA, 201 bp, Bos taurus; identical to SEQ ID NO: 36201

SEQ ID NO: 116988 - DNA, 201 bp, Bos taurus; identical to SEQ ID NO: 36202

SEQ ID NO: 116989 - DNA, 201 bp, Bos taurus; identical to SEQ ID NO: 36203

SEQ ID NO: 116990 - DNA, 201 bp, Bos taurus; identical to SEQ ID NO: 36204

SEQ ID NO: 116991 - DNA, 201 bp, Bos taurus; identical to SEQ ID NO: 36205

SEQ ID NO: 116992 - DNA, 201 bp, Bos taurus; identical to SEQ ID NO: 36206

SEQ ID NO: 116993 - DNA, 201 bp, Bos taurus; identical to SEQ ID NO: 36207

SEQ ID NO: 116994 - DNA, 201 bp, Bos taurus; identical to SEQ ID NO: 36208

SEQ ID NO: 116995 - DNA, 201 bp, Bos taurus; identical to SEQ ID NO: 36209

SEQ ID NO: 116996 - DNA, 201 bp, Bos taurus; identical to SEQ ID NO: 36210

SEQ ID NO: 116997 - DNA, 201 bp, Bos taurus; identical to SEQ ID NO: 36211

SEQ ID NO: 116998 - DNA, 201 bp, Bos taurus; identical to SEQ ID NO: 36212

SEQ ID NO: 116999 - DNA, 201 bp, Bos taurus; identical to SEQ ID NO: 36213

SEQ ID NO: 117000 - DNA, 201 bp, Bos taurus
gatgagtactcatattttatgtaagagacagtttaggaacaactttcataatgaaacagaggtgggtacagaaatttagcaaactggcctgtatgctgacygctttgagatctgggttccatgactgtcagcaaattggcatggaatgtgagtggtagaatatttaaagctcaagtcagaactgataaaaatgtattgaag

SEQ ID NO: 117001 - DNA, 201 bp, Bos taurus; identical to SEQ ID NO: 75728

SEQ ID NO: 117002 - DNA, 201 bp, Bos taurus
cttggatggccaaagatgaagagccctggtggagcctgtgggggacggatggagagccaaactcgtcagaggcagctacgaaagccaggaggactggagaycgtgaccaggcccagctcaacccaactgccactgcaagagcaagtcaacattgtaggaaaacaaaaaatgtttaaaaattagcacttaaaatggcttagg

SEQ ID NO: 117003 - DNA, 201 bp, Bos taurus; identical to SEQ ID NO: 75729

SEQ ID NO: 117004 - DNA, 201 bp, Bos taurus; identical to SEQ ID NO: 36268

SEQ ID NO: 117005 - DNA, 201 bp, Bos taurus; identical to SEQ ID NO: 36269

SEQ ID NO: 117006 - DNA, 201 bp, Bos taurus; identical to SEQ ID NO: 36270

SEQ ID NO: 117007 - DNA, 201 bp, Bos taurus
ctctgtctgacagccctgtattccagaacatggaattctgtattccagaaatggaaaccttaaaaaaaaaaatgtgcacctggacagatggccttgtatamgttgtctcctgggggagactcttactcactgggtcagcagcctgagtcagccctgaggaaaacatggcccgagggagtgaacaacagattgagaataatt

SEQ ID NO: 117008 - DNA, 201 bp, Bos taurus; identical to SEQ ID NO: 36272

SEQ ID NO: 117009 - DNA, 201 bp, Bos taurus
gggtatgaactaaacccagtataagacaaagacatttaacaactttggggaaaagttgccttgttcctaagaaagacacagaaagaattggcctcttaaakcctctggaaactgctggtctgatttggaaactcttggtggcaatctttctatttacctcaaggtaaaaccaacaccaagaaaggcagagggaggggctcc

SEQ ID NO: 117010 - DNA, 201 bp, Bos taurus; identical to SEQ ID NO: 36273

SEQ ID NO: 117011 - DNA, 201 bp, Bos taurus
agcaaagatgtctcacaggtgagggtactgcaggaaggaggggcaaaaccactcagccctgatatttgtctgaactttccggcaagcattgtggacttggrcagtttccccacagctgatgctccaggtggtgaagggcaggcttgccatctcttcttcctccccatttccttctgtcaccacagtggctctctggttcca

SEQ ID NO: 117012 - DNA, 201 bp, Bos taurus
gaagtgtccagctctgtgacccgtggactgcagcacgccaggcttccctgcctttcattatctccaagagtttgctcaaacaaatccatggagttggtgawgctttctaaccatctcatcctcggcagccctattctccctctgagttggcctcatttggggggctttgagggtaggggagtcatatcaatgtgtattttt

SEQ ID NO: 117013 - DNA, 201 bp, Bos taurus; identical to SEQ ID NO: 75733

SEQ ID NO: 117014 - DNA, 201 bp, Bos taurus; identical to SEQ ID NO: 75735

SEQ ID NO: 117015 - DNA, 201 bp, Bos taurus; identical to SEQ ID NO: 75736

SEQ ID NO: 117016 - DNA, 201 bp, Bos taurus; identical to SEQ ID NO: 75738

SEQ ID NO: 117017 - DNA, 201 bp, Bos taurus
acttatattttagttctgtttagagtttctgtgacttttcttctgttcctgattttaatagcaatttgagcctgagtttaaacttcacacatttctaaaaktgtcaactcccagcttcaaaccaatttatattttttaataattttacactcaaaaataaaaatattgctatttcaaattgaatacatatatatataacat

SEQ ID NO: 117018 - DNA, 201 bp, Bos taurus; identical to SEQ ID NO: 75742

SEQ ID NO: 117019 - DNA, 201 bp, Bos taurus
tatgtacatgtgaaagttgttattcaaaatgagaatggatgaccttaatttttagacatcaagtacatctgaaaatacgtcatgcattctcaacttcagtwagcagttcagttgttctataactgtaattcttctctggttgttttgaagactaaagcctacagacgcagtcctgtaaaaatcattggggaaaatgtgttt

SEQ ID NO: 117020 - DNA, 201 bp, Bos taurus
gtgggctacagtccatggggtcacaaggagtcagacacgactgggcgaattaacactaggcactgtcctcctctgagttttttctgtaactatctcctctyctcttctgtttagtatgaatcttgttcagagactagtgaatctttggggacacccttgcctctcactgaataaatattttactttcagaattggatattt

SEQ ID NO: 117021 - DNA, 201 bp, Bos taurus; identical to SEQ ID NO: 36276

SEQ ID NO: 117022 - DNA, 201 bp, Bos taurus
gttttgtttttgttgtgctgagaagtttcgaagaaatgaaaaactctggaatatcagattttaaggtataaagtctggcacgcgagacgccaaatgctttkgtttttggtgccacactgtgctttgggaatctgtaatgacgttctcagagactagaagaaaagagtaaaccagaagaagccttttaaaatttccgttcag

SEQ ID NO: 117023 - DNA, 201 bp, Bos taurus
atgatggacttttgtaactgtctagcttccattgggtaaaaccttgttatcaaagatttaaaggatccatttagaatcacatgtccatcacaggaaagacyataaatcaagatggacaggcgaggagtgataccccaaacctcctttcaacccaccttgtgggtactgctttgagcacacgtaggcttcactgggttatgt

SEQ ID NO: 117024 - DNA, 201 bp, Bos taurus; identical to SEQ ID NO: 75754

SEQ ID NO: 117025 - DNA, 201 bp, Bos taurus
gagacaagaaaaggccccttccagtttccccagcccagatctttcattgaaattagaggaaacttctcctgtctgtcacctgaatctttgctcttgagaaygtggtttcaggtgggggctggcggcctcttgacccctgtggtctgaaaatatttacttaggaaggactgtgctcttgtcccaaagagtctggggtcttgt

SEQ ID NO: 117026 - DNA, 201 bp, Bos taurus; identical to SEQ ID NO: 75756

SEQ ID NO: 117027 - DNA, 201 bp, Bos taurus
tctctgaatgtttgtcatcgggatcatgtgaggccccctctcatccattttcttgagagtttctgggttggcagccagtgtgtttactgaacagtgcttcrtggccattgatagactcagggtaaaaactacagcatcacctagatgtcgacagacatgctgtctgtgtaatgtatatatttacacatgtgtattagaata

SEQ ID NO: 117028 - DNA, 201 bp, Bos taurus
cgaaattccagggccttaagtaagagacctttatttttcacaagctggaagctggaagtctgagggtgccgagtaaggtcagcttcctccaggctggtacrtggccagcctctcaccttggctcgcatggtggggagagagtgctggtctctcgtcctctttttataagggcacggcttccttcatgggaccccaactctc

SEQ ID NO: 117029 - DNA, 201 bp, Bos taurus; identical to SEQ ID NO: 75757

SEQ ID NO: 117030 - DNA, 201 bp, Bos taurus; identical to SEQ ID NO: 36280

SEQ ID NO: 117031 - DNA, 201 bp, Bos taurus; identical to SEQ ID NO: 36281

SEQ ID NO: 117032 - DNA, 201 bp, Bos taurus; identical to SEQ ID NO: 75761

SEQ ID NO: 117033 - DNA, 201 bp, Bos taurus; identical to SEQ ID NO: 36282

SEQ ID NO: 117034 - DNA, 201 bp, Bos taurus; identical to SEQ ID NO: 36283

SEQ ID NO: 117035 - DNA, 201 bp, Bos taurus
agctcaggggcgctatctcaggagcacgcacggcccgaaaggaacagtcgagtctgttttctcccatgtcaactgtaagacttgttggtctcggcagccaraggggagaagaaagtgccacggcccatcagctgcctcttctgaacgcagtcaggaaagcccagaacaaatgcacaaggtgacctaaatcgggggcaaggt

SEQ ID NO: 117036 - DNA, 201 bp, Bos taurus; identical to SEQ ID NO: 75764

SEQ ID NO: 117037 - DNA, 201 bp, Bos taurus
gacacgtctctgccgtttacacacgtaggccttgctggcttcaggtttcggttgcgatacgggatcgtctgagtaggctctccaaagccacacatgggacytggacatcccctggagtagcagtagccatgttatattgcaattatccatttgtgtgtctaagtcttatttgtctttgtcacccagtacctaagagagtat

SEQ ID NO: 117038 - DNA, 201 bp, Bos taurus; identical to SEQ ID NO: 75765

SEQ ID NO: 117039 - DNA, 201 bp, Bos taurus
aattcagatagagccagaagaagattcaaaagaccagtgaaaaattataacttggaaaagtcttgttttacacatttggccaaaaccaaacatgctgttcrtcactgtaaaggatgcagctgctcctccgctgtgagcttgcacttcacagagccgtggtcttcctggcgcggtggccgctccacgctgaccctccctgga

SEQ ID NO: 117040 - DNA, 201 bp, Bos taurus; identical to SEQ ID NO: 75767

SEQ ID NO: 117041 - DNA, 201 bp, Bos taurus; identical to SEQ ID NO: 36284

SEQ ID NO: 117042 - DNA, 201 bp, Bos taurus
tgctttcttcctatttcagtttcctgaaaagagttttcctttagttttggaagcactgcaaacgtgagcgttttaatagctggccttacagagggctcagygcagttcagagctgtgtaaattagacagacttcagggtgtggtggatgctgggccacatgaggcgtgtgtgtgttggtgagtgtgtgcgtgtccatgtgc

SEQ ID NO: 117043 - DNA, 201 bp, Bos taurus
ccaacaatagccacttgctggaagtcactatctagttaattgaattttcatggcggttcctttgaacctcaagttgcaagtgtatgtacttgaaggtgatsattagaaagacaggtgtccatttcctgggtggtctgagggattctgagatgattgttgatcccagttcttccaaacattcttctctatcatcatctgagg

SEQ ID NO: 117044 - DNA, 201 bp, Bos taurus; identical to SEQ ID NO: 36287

SEQ ID NO: 117045 - DNA, 201 bp, Bos taurus; identical to SEQ ID NO: 75769

SEQ ID NO: 117046 - DNA, 201 bp, Bos taurus; identical to SEQ ID NO: 75770

SEQ ID NO: 117047 - DNA, 201 bp, Bos taurus; identical to SEQ ID NO: 75771

SEQ ID NO: 117048 - DNA, 201 bp, Bos taurus; identical to SEQ ID NO: 75772

SEQ ID NO: 117049 - DNA, 201 bp, Bos taurus
ttttcatctttaagcccaggaagttttgtaaagttcctcatatcatataacgttcaggaaaattccaggaaaaggtgatatgaagatgtaataaggaaaamaaaaaacagaaatgaacttcatcttggttacttgcaaggatcttctgataaaaatcccatttgcagttagaacaaagaaaggggatacatgggaagaaat

SEQ ID NO: 117050 - DNA, 201 bp, Bos taurus
gtttcactatgggttgagttgtgtgccctcctaattcatctgttgacatcctaagccccaggacctcagaatgtggccttatttcgtgatgaccaatgtarttacttgcttccctggtggctcagatggtaaagagtccacctgcaatgcaggaggcctgggttcattccctgggccgggaagatgccctggaaaatggta

SEQ ID NO: 117051 - DNA, 201 bp, Bos taurus; identical to SEQ ID NO: 75774

SEQ ID NO: 117052 - DNA, 201 bp, Bos taurus; identical to SEQ ID NO: 36291

SEQ ID NO: 117053 - DNA, 201 bp, Bos taurus; identical to SEQ ID NO: 36292

SEQ ID NO: 117054 - DNA, 201 bp, Bos taurus; identical to SEQ ID NO: 36293

SEQ ID NO: 117055 - DNA, 201 bp, Bos taurus; identical to SEQ ID NO: 36294

SEQ ID NO: 117056 - DNA, 201 bp, Bos taurus; identical to SEQ ID NO: 36295

SEQ ID NO: 117057 - DNA, 201 bp, Bos taurus; identical to SEQ ID NO: 36296

SEQ ID NO: 117058 - DNA, 201 bp, Bos taurus; identical to SEQ ID NO: 36297

SEQ ID NO: 117059 - DNA, 201 bp, Bos taurus; identical to SEQ ID NO: 36298

SEQ ID NO: 117060 - DNA, 201 bp, Bos taurus; identical to SEQ ID NO: 36299

SEQ ID NO: 117061 - DNA, 201 bp, Bos taurus; identical to SEQ ID NO: 36300

SEQ ID NO: 117062 - DNA, 201 bp, Bos taurus; identical to SEQ ID NO: 36302

SEQ ID NO: 117063 - DNA, 201 bp, Bos taurus; identical to SEQ ID NO: 36303

SEQ ID NO: 117064 - DNA, 201 bp, Bos taurus; identical to SEQ ID NO: 36304

SEQ ID NO: 117065 - DNA, 201 bp, Bos taurus; identical to SEQ ID NO: 36305

SEQ ID NO: 117066 - DNA, 201 bp, Bos taurus; identical to SEQ ID NO: 75788

SEQ ID NO: 117067 - DNA, 201 bp, Bos taurus; identical to SEQ ID NO: 75789

SEQ ID NO: 117068 - DNA, 201 bp, Bos taurus; identical to SEQ ID NO: 75790

SEQ ID NO: 117069 - DNA, 201 bp, Bos taurus; identical to SEQ ID NO: 75791

SEQ ID NO: 117070 - DNA, 201 bp, Bos taurus; identical to SEQ ID NO: 75792

SEQ ID NO: 117071 - DNA, 201 bp, Bos taurus; identical to SEQ ID NO: 75794

SEQ ID NO: 117072 - DNA, 201 bp, Bos taurus; identical to SEQ ID NO: 75795

SEQ ID NO: 117073 - DNA, 201 bp, Bos taurus; identical to SEQ ID NO: 75796

SEQ ID NO: 117074 - DNA, 201 bp, Bos taurus; identical to SEQ ID NO: 75797

SEQ ID NO: 117075 - DNA, 201 bp, Bos taurus; identical to SEQ ID NO: 75798

SEQ ID NO: 117076 - DNA, 201 bp, Bos taurus; identical to SEQ ID NO: 75799

SEQ ID NO: 117077 - DNA, 201 bp, Bos taurus; identical to SEQ ID NO: 75800

SEQ ID NO: 117078 - DNA, 201 bp, Bos taurus; identical to SEQ ID NO: 36306

SEQ ID NO: 117079 - DNA, 201 bp, Bos taurus; identical to SEQ ID NO: 36307

SEQ ID NO: 117080 - DNA, 201 bp, Bos taurus; identical to SEQ ID NO: 36308

SEQ ID NO: 117081 - DNA, 201 bp, Bos taurus; identical to SEQ ID NO: 36309

SEQ ID NO: 117082 - DNA, 201 bp, Bos taurus; identical to SEQ ID NO: 36310

SEQ ID NO: 117083 - DNA, 201 bp, Bos taurus; identical to SEQ ID NO: 36311

SEQ ID NO: 117084 - DNA, 201 bp, Bos taurus; identical to SEQ ID NO: 36312

SEQ ID NO: 117085 - DNA, 201 bp, Bos taurus; identical to SEQ ID NO: 36313

SEQ ID NO: 117086 - DNA, 201 bp, Bos taurus; identical to SEQ ID NO: 36314

SEQ ID NO: 117087 - DNA, 201 bp, Bos taurus; identical to SEQ ID NO: 36315

SEQ ID NO: 117088 - DNA, 201 bp, Bos taurus; identical to SEQ ID NO: 36316

SEQ ID NO: 117089 - DNA, 201 bp, Bos taurus; identical to SEQ ID NO: 36317

SEQ ID NO: 117090 - DNA, 201 bp, Bos taurus; identical to SEQ ID NO: 36318

SEQ ID NO: 117091 - DNA, 201 bp, Bos taurus; identical to SEQ ID NO: 36319

SEQ ID NO: 117092 - DNA, 201 bp, Bos taurus; identical to SEQ ID NO: 36320

SEQ ID NO: 117093 - DNA, 201 bp, Bos taurus; identical to SEQ ID NO: 36321

SEQ ID NO: 117094 - DNA, 201 bp, Bos taurus; identical to SEQ ID NO: 36322

SEQ ID NO: 117095 - DNA, 201 bp, Bos taurus; identical to SEQ ID NO: 36323

SEQ ID NO: 117096 - DNA, 201 bp, Bos taurus; identical to SEQ ID NO: 36324

SEQ ID NO: 117097 - DNA, 201 bp, Bos taurus; identical to SEQ ID NO: 36325

SEQ ID NO: 117098 - DNA, 201 bp, Bos taurus; identical to SEQ ID NO: 36326

SEQ ID NO: 117099 - DNA, 201 bp, Bos taurus; identical to SEQ ID NO: 36327

SEQ ID NO: 117100 - DNA, 201 bp, Bos taurus; identical to SEQ ID NO: 36329

SEQ ID NO: 117101 - DNA, 201 bp, Bos taurus; identical to SEQ ID NO: 36330

SEQ ID NO: 117102 - DNA, 201 bp, Bos taurus; identical to SEQ ID NO: 75802

SEQ ID NO: 117103 - DNA, 201 bp, Bos taurus; identical to SEQ ID NO: 75803

SEQ ID NO: 117104 - DNA, 201 bp, Bos taurus; identical to SEQ ID NO: 75804

SEQ ID NO: 117105 - DNA, 201 bp, Bos taurus; identical to SEQ ID NO: 75805

SEQ ID NO: 117106 - DNA, 201 bp, Bos taurus; identical to SEQ ID NO: 75806

SEQ ID NO: 117107 - DNA, 201 bp, Bos taurus; identical to SEQ ID NO: 75807

SEQ ID NO: 117108 - DNA, 201 bp, Bos taurus; identical to SEQ ID NO: 75808

SEQ ID NO: 117109 - DNA, 201 bp, Bos taurus; identical to SEQ ID NO: 75809

SEQ ID NO: 117110 - DNA, 201 bp, Bos taurus; identical to SEQ ID NO: 75810

SEQ ID NO: 117111 - DNA, 201 bp, Bos taurus; identical to SEQ ID NO: 75815

SEQ ID NO: 117112 - DNA, 201 bp, Bos taurus; identical to SEQ ID NO: 36335

SEQ ID NO: 117113 - DNA, 201 bp, Bos taurus; identical to SEQ ID NO: 36336

SEQ ID NO: 117114 - DNA, 201 bp, Bos taurus; identical to SEQ ID NO: 75816

SEQ ID NO: 117115 - DNA, 201 bp, Bos taurus; identical to SEQ ID NO: 36337

SEQ ID NO: 117116 - DNA, 201 bp, Bos taurus; identical to SEQ ID NO: 75817

SEQ ID NO: 117117 - DNA, 201 bp, Bos taurus; identical to SEQ ID NO: 75818

SEQ ID NO: 117118 - DNA, 201 bp, Bos taurus; identical to SEQ ID NO: 75819

SEQ ID NO: 117119 - DNA, 201 bp, Bos taurus; identical to SEQ ID NO: 75820

SEQ ID NO: 117120 - DNA, 201 bp, Bos taurus; identical to SEQ ID NO: 36339

SEQ ID NO: 117121 - DNA, 201 bp, Bos taurus; identical to SEQ ID NO: 36340

SEQ ID NO: 117122 - DNA, 201 bp, Bos taurus; identical to SEQ ID NO: 36341

SEQ ID NO: 117123 - DNA, 201 bp, Bos taurus; identical to SEQ ID NO: 36342

SEQ ID NO: 117124 - DNA, 201 bp, Bos taurus; identical to SEQ ID NO: 36343

SEQ ID NO: 117125 - DNA, 201 bp, Bos taurus; identical to SEQ ID NO: 36344

SEQ ID NO: 117126 - DNA, 201 bp, Bos taurus; identical to SEQ ID NO: 36345

SEQ ID NO: 117127 - DNA, 201 bp, Bos taurus; identical to SEQ ID NO: 75822

SEQ ID NO: 117128 - DNA, 201 bp, Bos taurus; identical to SEQ ID NO: 36347

SEQ ID NO: 117129 - DNA, 201 bp, Bos taurus
ccgcatgacacagttgtgagaaatcatgaaggaaatttctaatacagctctgtgggagtaaaagctttccgcctatggagcaactgatacaatattatccygccaaatgtatgattttggtaaatgactgtgaccttcagctatagtatagccttcatgacacacatttacttgtaataacttcctttctggaaaaatgta

SEQ ID NO: 117130 - DNA, 201 bp, Bos taurus
ttatacagggagagcttagattggtgggaatgggttataaagcagcaaatagcagcctattatatcacctttcacactatgcatgtgtttgaagtatattytacctatctggccagcaggtagctggacggatgctatgattcatacagcatataaaagatgtcatttgtgatatgactcccaaattctagacacccatgt

SEQ ID NO: 117131 - DNA, 201 bp, Bos taurus; identical to SEQ ID NO: 36380

SEQ ID NO: 117132 - DNA, 201 bp, Bos taurus; identical to SEQ ID NO: 36381

SEQ ID NO: 117133 - DNA, 201 bp, Bos taurus; identical to SEQ ID NO: 36383

SEQ ID NO: 117134 - DNA, 201 bp, Bos taurus; identical to SEQ ID NO: 36384

SEQ ID NO: 117135 - DNA, 201 bp, Bos taurus; identical to SEQ ID NO: 75864

SEQ ID NO: 117136 - DNA, 201 bp, Bos taurus; identical to SEQ ID NO: 36389

SEQ ID NO: 117137 - DNA, 201 bp, Bos taurus
ggatctcctcctcagcagttacacagggccttcccagaggatagagtaggttagcaattaactaggcggctttggagacagaggagtgctaggtgccctgrtcgtgggtgtggcaggtaggggcccaggagtgcctcacatctttagatctgtcctgcgcatgttgataaagatacatattaacttgatactgacattttt

SEQ ID NO: 117138 - DNA, 201 bp, Bos taurus; identical to SEQ ID NO: 36390

SEQ ID NO: 117139 - DNA, 201 bp, Bos taurus; identical to SEQ ID NO: 36391

SEQ ID NO: 117140 - DNA, 201 bp, Bos taurus; identical to SEQ ID NO: 36392

SEQ ID NO: 117141 - DNA, 201 bp, Bos taurus; identical to SEQ ID NO: 36393

SEQ ID NO: 117142 - DNA, 201 bp, Bos taurus; identical to SEQ ID NO: 36394

SEQ ID NO: 117143 - DNA, 201 bp, Bos taurus; identical to SEQ ID NO: 75865

SEQ ID NO: 117144 - DNA, 201 bp, Bos taurus; identical to SEQ ID NO: 75866

SEQ ID NO: 117145 - DNA, 201 bp, Bos taurus; identical to SEQ ID NO: 75867

SEQ ID NO: 117146 - DNA, 201 bp, Bos taurus; identical to SEQ ID NO: 75868

SEQ ID NO: 117147 - DNA, 201 bp, Bos taurus; identical to SEQ ID NO: 36397

SEQ ID NO: 117148 - DNA, 201 bp, Bos taurus; identical to SEQ ID NO: 75874

SEQ ID NO: 117149 - DNA, 201 bp, Bos taurus; identical to SEQ ID NO: 75875

SEQ ID NO: 117150 - DNA, 201 bp, Bos taurus; identical to SEQ ID NO: 75876

SEQ ID NO: 117151 - DNA, 201 bp, Bos taurus; identical to SEQ ID NO: 36402

SEQ ID NO: 117152 - DNA, 201 bp, Bos taurus; identical to SEQ ID NO: 36403

SEQ ID NO: 117153 - DNA, 201 bp, Bos taurus; identical to SEQ ID NO: 75877

SEQ ID NO: 117154 - DNA, 201 bp, Bos taurus; identical to SEQ ID NO: 75878

SEQ ID NO: 117155 - DNA, 201 bp, Bos taurus; identical to SEQ ID NO: 36404

SEQ ID NO: 117156 - DNA, 201 bp, Bos taurus; identical to SEQ ID NO: 36405

SEQ ID NO: 117157 - DNA, 201 bp, Bos taurus; identical to SEQ ID NO: 36406

SEQ ID NO: 117158 - DNA, 201 bp, Bos taurus; identical to SEQ ID NO: 75882

SEQ ID NO: 117159 - DNA, 201 bp, Bos taurus; identical to SEQ ID NO: 36407

SEQ ID NO: 117160 - DNA, 201 bp, Bos taurus; identical to SEQ ID NO: 36408

SEQ ID NO: 117161 - DNA, 201 bp, Bos taurus; identical to SEQ ID NO: 75883

SEQ ID NO: 117162 - DNA, 201 bp, Bos taurus
caattctgacttattctgcctaccaggccaaaaagaggaaacaatcatgtcaaagaaaagaggaaatgtccttttaagtcaagaaaactttatatgtgagrgtgcaaaggcagagaaggcatatcttttggaagaataaatacttgatgtggctgaaagatacattgaagggaggtggatgtagcaggtgagactgaaaag

SEQ ID NO: 117163 - DNA, 201 bp, Bos taurus
agccaagatgcaggcctggctcagggaccagctcagctaagcatcttcaacctcattcttctctacacgatgggggcaaggcggcagaggcaaggtgaggkaaggtcttaccggcctgtctgggtgggctgagagaggtggcaccatcacacagacaggtgaccatcattaggtaaatcagtgggagaaaacagaccccag

SEQ ID NO: 117164 - DNA, 201 bp, Bos taurus; identical to SEQ ID NO: 75884

SEQ ID NO: 117165 - DNA, 201 bp, Bos taurus; identical to SEQ ID NO: 36409

SEQ ID NO: 117166 - DNA, 201 bp, Bos taurus; identical to SEQ ID NO: 36410

SEQ ID NO: 117167 - DNA, 201 bp, Bos taurus
tttttaaattggggtttaattgctttacagtgttgttttagtttttactgtaggtccaagtgaatcagctgtaggtgtacatatatcctctccctgttggygctcctccccgcccccacattactatttaacctttaaacattaccctttaaaaataaatatctctacagaataactggtctagctttttcaacaagttgg

SEQ ID NO: 117168 - DNA, 201 bp, Bos taurus
cactgaggtactcttgttacactatgggctatgaggacctaacatgtagccccactacggtcaactttgtggtggccactatgaataaaacaagtgctatyttctctacttttatcaatgaatcttgagacagatcagaaactagcatatacacttatcctgattctcagctttcaaaaataaacaaaatagggctatacc

SEQ ID NO: 117169 - DNA, 201 bp, Bos taurus; identical to SEQ ID NO: 75885

SEQ ID NO: 117170 - DNA, 201 bp, Bos taurus; identical to SEQ ID NO: 36411

SEQ ID NO: 117171 - DNA, 201 bp, Bos taurus
cctagcaaaatttctaataagtggtagaaggcagggggacccacccatgttacttctgggagattattctacatatttgtttttaatttgagataaagaarctaaacaaatctttggttataactaaaatgtaactgttacccttgtaagttcaaggcatttttcttaattttgaacatgttgcattcttcctgtttaaac

SEQ ID NO: 117172 - DNA, 201 bp, Bos taurus; identical to SEQ ID NO: 75887

SEQ ID NO: 117173 - DNA, 201 bp, Bos taurus; identical to SEQ ID NO: 36413

SEQ ID NO: 117174 - DNA, 201 bp, Bos taurus; identical to SEQ ID NO: 75890

SEQ ID NO: 117175 - DNA, 201 bp, Bos taurus; identical to SEQ ID NO: 36418

SEQ ID NO: 117176 - DNA, 201 bp, Bos taurus; identical to SEQ ID NO: 36420

SEQ ID NO: 117177 - DNA, 201 bp, Bos taurus
attattatgcactcatagaatggaatgccgtgtagcctttaaacagaatgaacagctccataaaaatcaaggcgcagaacaatgtcacacccatatatgtrtgcatgtatatgattgcagacagggatatttaaacatgcataaactatctctgaaacagtttgaaagagatatgattttaagttcacaaagaaattgctg

SEQ ID NO: 117178 - DNA, 201 bp, Bos taurus; identical to SEQ ID NO: 36421

SEQ ID NO: 117179 - DNA, 201 bp, Bos taurus; identical to SEQ ID NO: 36422

SEQ ID NO: 117180 - DNA, 201 bp, Bos taurus; identical to SEQ ID NO: 36423

SEQ ID NO: 117181 - DNA, 201 bp, Bos taurus
ttctgaattcagggaggcctgggttcaaatcccagccctgctgtcacaaaccatgggttcttgcatgtcctctgacttctcaagactcagtttcccacacytacaaaccagagcaataaatcaggcctaccccaccgaatcacataacacatttagcacagggtccacagccgggggacctcatgattattaactaccctt

SEQ ID NO: 117182 - DNA, 201 bp, Bos taurus; identical to SEQ ID NO: 36426

SEQ ID NO: 117183 - DNA, 201 bp, Bos taurus; identical to SEQ ID NO: 36428

SEQ ID NO: 117184 - DNA, 201 bp, Bos taurus; identical to SEQ ID NO: 75906

SEQ ID NO: 117185 - DNA, 201 bp, Bos taurus
actgggccgaagtgcccagaaacactctccatagacgcgggactccaggggtcagccagcagccgccctcacagtgcggccgagtgacaccatctgtcccyggcatctgctcccactcagagcacacctgaggacaatggaaagaaggacacctgtctcagcctcagccggtgtcccgtggtctgcccctggagtggccag

SEQ ID NO: 117186 - DNA, 201 bp, Bos taurus; identical to SEQ ID NO: 75908

SEQ ID NO: 117187 - DNA, 201 bp, Bos taurus
gaactgcatggagtgtgttgaggagaggttgtggaaatgctgtgattataaccactgccttcaaagtattttgctttgaaggggagcagagaaacaggagrggaattgaaaagtattctggggtcatttgaggtgttttgattttatttttcataggacagatcacagcatgtttggatgctggcaggaaaagtctagaag

SEQ ID NO: 117188 - DNA, 201 bp, Bos taurus
tctttgttaaataggaatctaatggagttatgggcatttactctttttatcatataggtgagggaaggaaaaaaatgctagtaaccttctactggtttgasaggacaatcttataagtattcatactgtatagaaatatggaaatgtccaacatgaaatctagagagcatcagattattaagtaagacaatttatcgaatt

SEQ ID NO: 117189 - DNA, 201 bp, Bos taurus; identical to SEQ ID NO: 75911

SEQ ID NO: 117190 - DNA, 201 bp, Bos taurus; identical to SEQ ID NO: 36429

SEQ ID NO: 117191 - DNA, 201 bp, Bos taurus; identical to SEQ ID NO: 36431

SEQ ID NO: 117192 - DNA, 201 bp, Bos taurus; identical to SEQ ID NO: 75914

SEQ ID NO: 117193 - DNA, 201 bp, Bos taurus; identical to SEQ ID NO: 75915

SEQ ID NO: 117194 - DNA, 201 bp, Bos taurus; identical to SEQ ID NO: 75916

SEQ ID NO: 117195 - DNA, 201 bp, Bos taurus
gggcatctggagcccggccttggcctcttttctctggttccgggagtattaacccagcttctgtggaaaactcccccagggtcgcgcgaggcggggaatgrtgtgtggaaggccctgcccctttgatctcttttcatcaacttctcagtgcgcagcggcggcgggctggaggtgagctcggagcaggccagagccgccctt

SEQ ID NO: 117196 - DNA, 201 bp, Bos taurus; identical to SEQ ID NO: 36434

SEQ ID NO: 117197 - DNA, 201 bp, Bos taurus
ccttgctgtccaggagaccctccaaagtcttctccaacagcaaatgtgttcacacaaatctctcagccagggtggattccaacaacgaggcctatgggtarccttagcatcagtcttcttttgacctgcaaggaatttactagtcaagaaaggctccttgactttgagaatgacaaatacatagtctcttatctgggcacg

SEQ ID NO: 117198 - DNA, 201 bp, Bos taurus
ggagtgaatctccagactccagtactatgaaaggaaactaggcaaaacccagaaaaatccttgagttgggaagatagagttgggagttcagggcctccacrgtgggtggtgtgcatagggcaagatatcagagagaaaacagctgcttggagggacagagagcactggagacctgaagaaggtccctctcaggccttttgc

SEQ ID NO: 117199 - DNA, 201 bp, Bos taurus
ctttaccactgagccaccaggatgccccttttctttgtgcattcttaaacctttcccttttctacttcttttcattaaagcctttaaaagtcatttttttwaatctcattccaataaatatcaatgtaactccctcattattattaatatcctttaagaatgaggtggtctttttgtttctatttaatcacaagaatctat

SEQ ID NO: 117200 - DNA, 201 bp, Bos taurus; identical to SEQ ID NO: 36437

SEQ ID NO: 117201 - DNA, 201 bp, Bos taurus
aatagccttctgctccattcaatccccgagggctcaggaagcatgatggtgattaaacagagcctacgtggaagctaaggaaatgcttcttctgtcctttkgtcggtaatgcgttcatacctgtctcctctgagagcagcacaagccccttcttgctgggaacacagacctcctagcgcctgttcccctggaggaaaagag

SEQ ID NO: 117202 - DNA, 201 bp, Bos taurus; identical to SEQ ID NO: 36439

SEQ ID NO: 117203 - DNA, 201 bp, Bos taurus; identical to SEQ ID NO: 36440

SEQ ID NO: 117204 - DNA, 201 bp, Bos taurus
tggcacagaacggacattcgataaatcattgctcaataagtgaacaaacttcttatttaaatcttacatcaagctttcgcttacaactagtttgaaagggraaaaaaaaattcttttcaatttaactcacttaaaatgcaaacacttaattccaaacaagttggtaatcaggctaggtccttatgtagccaactcaacatt

SEQ ID NO: 117205 - DNA, 201 bp, Bos taurus; identical to SEQ ID NO: 36443

SEQ ID NO: 117206 - DNA, 201 bp, Bos taurus; identical to SEQ ID NO: 36445

SEQ ID NO: 117207 - DNA, 201 bp, Bos taurus
cctttggggaaaatattatttagagcagtagctctcaaactatagccttcatcagaatttatttaaagggcttgttaaaatacagatttctgggccataamccccagtgtttctgacatagtagatctggaggggacccaagaatttgcatttttaacaagttttgggatgatgttaatgctactggtttgggaaccactg

SEQ ID NO: 117208 - DNA, 201 bp, Bos taurus; identical to SEQ ID NO: 36447

SEQ ID NO: 117209 - DNA, 201 bp, Bos taurus
ccatgataacggagtggcagtcttcctacaaactgcctgttcttccgctctgaagaacagtaaatagataatttctgaatgtctagattcatgaggtttayttaccagctaatggcttctgacctccgaatctttaaacgaataggaaaagaatgtccttgtttcatagaagcctatgggctgggaacaagcagtctgggg

SEQ ID NO: 117210 - DNA, 201 bp, Bos taurus; identical to SEQ ID NO: 36448

SEQ ID NO: 117211 - DNA, 201 bp, Bos taurus
aaactgaactgaactgttaatctcataaatttctacatcagatctccatctaaaacaagaaccagttaacacccaaatgtgcacagacagaatctcaggcmtctcctgtccctgtctattgccttcctattggcaaagtctcagctaatactaatcacttcagcacaaatatatgtacatatatacacaaataggcattat

SEQ ID NO: 117212 - DNA, 201 bp, Bos taurus; identical to SEQ ID NO: 36449

SEQ ID NO: 117213 - DNA, 201 bp, Bos taurus; identical to SEQ ID NO: 36450

SEQ ID NO: 117214 - DNA, 201 bp, Bos taurus; identical to SEQ ID NO: 36453

SEQ ID NO: 117215 - DNA, 201 bp, Bos taurus
gtccagtggcttttcattagagaagagaaaagaagcagaagcattattgacactgtttagatcaatgtccacagtggaaggctagactctcttgataaaaktgtcatgaaaaagctcaaaagcaatccaaccgtctcactagactctaatccctgatatcatctccatccccccaacacacattccccctctacactttga

SEQ ID NO: 117216 - DNA, 201 bp, Bos taurus
atccactcactgatccccatcccactcatggcccccatatctaagccataaagtcttgcctataattccttcttcacccagctgtcctttatcatcttcaytggcccttagaattcagctgcaacagtgaaaatcagtcgctcccaagcttgatgatacattagactcacctggggcagtaactgcttcagaggagccgtg

SEQ ID NO: 117217 - DNA, 201 bp, Bos taurus
atccaggagaagtctgggtgatttgcctgctagaaataacaggtgaaggtgagaatccatcatcctgcaggtctcagctgaagtgtgaccttctcaggaayggcctccctgagttggttaaccagtggtttttatatcataccatctagtgatcgtctggactatcaactcaacaagcgcagagatcacagctgtcttgtt

SEQ ID NO: 117218 - DNA, 201 bp, Bos taurus
ccaggaattgaacccagggccacagcagtgaaagtcctgaccaccatggaagtccccatgtggagaactttgcatgttatcccattaattgtccctcaaamgtattattattcccactttgagaaatttgaggttttcatggagtaactcagtgacagaaccaggatccaaaccagggtctgttgtctccaaaactctctt

SEQ ID NO: 117219 - DNA, 201 bp, Bos taurus
atctcgactcaggtcctctggccctgcctgcacagggagcaatggtaggctctctgattagcaatcttgatgtcccctttcatttgtgagagggagactgmgtggtgcagagggcaaggccccaggatgggagtcagatctggctggacagatacagtaacttactagccatgctggggagagagtttacttaaacatctt

SEQ ID NO: 117220 - DNA, 201 bp, Bos taurus
ggcacctagtatagggcttgaactcgaccactggggcaagagagaaaaagatgtaaacatcataggaagaatttcctctaagggcagtttttataatcagycaaaagcacttgtatgcttacttttgtgtataaagattcagccttgctaatctgatcagttcccactttattcctgtttattcagatcattgccccaaga

SEQ ID NO: 117221 - DNA, 201 bp, Bos taurus
tcaagagggaagaaaccaacagctgctgtggcctcagaccattactctggtatttgcttagaagacctttgggaacacagataaggagaaaactaaaacarggtatctgggcccaagacactgaggaagctgctggcactttccttcctttgaaccctgaggaagaaggagaggcagctgaatgttcttttaaccctctcc

SEQ ID NO: 117222 - DNA, 201 bp, Bos taurus
ggatttaggaatggttctgagtgataagatctggctatggaattctaggaagtccagatattttagatctgcatattaacatcccaaatcagtgccctccrgataggttgggactgtggcttcacatgtgtttgctactggttgccagagcaaccaaggagaatgagaaaaccattcatcataaatcccacctggtgctgc

SEQ ID NO: 117223 - DNA, 201 bp, Bos taurus
tggccgcgcgcggcgcagccagtgggcagcgcatccctccaagcagggtctctccattttcagggccggggaagcaacaataagctgagccgagcggccgmccaggctcgccgcactggcggcgccccccgtatctcctgcacccccgggtaccggggactccccgcacgcggcccctgccacgcaccgaccccgcacgcc

SEQ ID NO: 117224 - DNA, 201 bp, Bos taurus
atcctactgcagagagcatcatctggttctaaaaagtgacactatattcagagggttttctcttctcagtgagggagagagcggattagcaggaagggaartgacacatgtacagcttacatgttctgaaaggctgttgtaatgtaggcgagaagtgattgtgtttgaactaaagtagtaacaatcaagatgaaaagaagt

SEQ ID NO: 117225 - DNA, 201 bp, Bos taurus
atggagtagacatcacaccatccagaagcaacatatctaatcagagcagaaatgcactggcctgagcaagaaggtataatgtgaattcacagaggaagggraaaaaaaaggtccaaactgaatcaagccaaacaatcaagtaagcaaaccaatatggcaaatgagaaagactaaagtggagaagctaagaagaggttgctg

SEQ ID NO: 117226 - DNA, 201 bp, Bos taurus
ctcagaggcgatcacgttcctcccagggctggaaagcagattggcaaaggccaaagatgagacaaaaggcatgagccctggaaatgatttaaaataacaayaacaacaacaaaattgattagggcctcccagttccaattctgtctccccttccggggatgattcctgggctatccagcaaatcccttaaggcctgggata

SEQ ID NO: 117227 - DNA, 201 bp, Bos taurus
ctccataaaaaacctgttagtgatgacttaccatccttttcacagactgaaaaatgaatgcatagagaggtgaagtggtgaaggaggcccaaggcgtctcytggagcccgagctcctgtagctgcttccgcttctgggagtctgtcccttccacttccgggagcgggcgcgctcggccggcatcttgttgagttgagctca

SEQ ID NO: 117228 - DNA, 201 bp, Bos taurus; identical to SEQ ID NO: 36458

SEQ ID NO: 117229 - DNA, 201 bp, Bos taurus; identical to SEQ ID NO: 36459

SEQ ID NO: 117230 - DNA, 201 bp, Bos taurus; identical to SEQ ID NO: 36460

SEQ ID NO: 117231 - DNA, 201 bp, Bos taurus; identical to SEQ ID NO: 36461

SEQ ID NO: 117232 - DNA, 201 bp, Bos taurus; identical to SEQ ID NO: 36462

SEQ ID NO: 117233 - DNA, 201 bp, Bos taurus; identical to SEQ ID NO: 36463

SEQ ID NO: 117234 - DNA, 201 bp, Bos taurus; identical to SEQ ID NO: 36464

SEQ ID NO: 117235 - DNA, 201 bp, Bos taurus; identical to SEQ ID NO: 36465

SEQ ID NO: 117236 - DNA, 201 bp, Bos taurus; identical to SEQ ID NO: 36466

SEQ ID NO: 117237 - DNA, 201 bp, Bos taurus; identical to SEQ ID NO: 36467

SEQ ID NO: 117238 - DNA, 201 bp, Bos taurus; identical to SEQ ID NO: 36468

SEQ ID NO: 117239 - DNA, 201 bp, Bos taurus; identical to SEQ ID NO: 36470

SEQ ID NO: 117240 - DNA, 201 bp, Bos taurus; identical to SEQ ID NO: 36472

SEQ ID NO: 117241 - DNA, 201 bp, Bos taurus; identical to SEQ ID NO: 36473

SEQ ID NO: 117242 - DNA, 201 bp, Bos taurus; identical to SEQ ID NO: 36474

SEQ ID NO: 117243 - DNA, 201 bp, Bos taurus; identical to SEQ ID NO: 36475

SEQ ID NO: 117244 - DNA, 201 bp, Bos taurus; identical to SEQ ID NO: 36476

SEQ ID NO: 117245 - DNA, 201 bp, Bos taurus; identical to SEQ ID NO: 36477

SEQ ID NO: 117246 - DNA, 201 bp, Bos taurus
cccagcgcatttaacaatctctttctgtttttactagtgggcttctagtttgctttgtgtgggatggggtcacaggtcacagccagtcttttatcacttayaacaataaagatggtcttctttcttaaactttaaatgcaggaagcttagattgttttctagtctgaaaacaaaatctttttaaaaatcttccctgtttcc

SEQ ID NO: 117247 - DNA, 201 bp, Bos taurus; identical to SEQ ID NO: 36478

SEQ ID NO: 117248 - DNA, 201 bp, Bos taurus; identical to SEQ ID NO: 36479

SEQ ID NO: 117249 - DNA, 201 bp, Bos taurus; identical to SEQ ID NO: 36480

SEQ ID NO: 117250 - DNA, 201 bp, Bos taurus; identical to SEQ ID NO: 36481

SEQ ID NO: 117251 - DNA, 201 bp, Bos taurus; identical to SEQ ID NO: 36482

SEQ ID NO: 117252 - DNA, 201 bp, Bos taurus; identical to SEQ ID NO: 36483

SEQ ID NO: 117253 - DNA, 201 bp, Bos taurus; identical to SEQ ID NO: 36484

SEQ ID NO: 117254 - DNA, 201 bp, Bos taurus; identical to SEQ ID NO: 36485

SEQ ID NO: 117255 - DNA, 201 bp, Bos taurus; identical to SEQ ID NO: 36486

SEQ ID NO: 117256 - DNA, 201 bp, Bos taurus; identical to SEQ ID NO: 36487

SEQ ID NO: 117257 - DNA, 201 bp, Bos taurus; identical to SEQ ID NO: 36488

SEQ ID NO: 117258 - DNA, 201 bp, Bos taurus; identical to SEQ ID NO: 36489

SEQ ID NO: 117259 - DNA, 201 bp, Bos taurus; identical to SEQ ID NO: 36490

SEQ ID NO: 117260 - DNA, 201 bp, Bos taurus; identical to SEQ ID NO: 36491

SEQ ID NO: 117261 - DNA, 201 bp, Bos taurus; identical to SEQ ID NO: 36492

SEQ ID NO: 117262 - DNA, 201 bp, Bos taurus; identical to SEQ ID NO: 36493

SEQ ID NO: 117263 - DNA, 201 bp, Bos taurus; identical to SEQ ID NO: 36494

SEQ ID NO: 117264 - DNA, 201 bp, Bos taurus; identical to SEQ ID NO: 36495

SEQ ID NO: 117265 - DNA, 201 bp, Bos taurus; identical to SEQ ID NO: 36496

SEQ ID NO: 117266 - DNA, 201 bp, Bos taurus; identical to SEQ ID NO: 36497

SEQ ID NO: 117267 - DNA, 201 bp, Bos taurus; identical to SEQ ID NO: 36501

SEQ ID NO: 117268 - DNA, 201 bp, Bos taurus; identical to SEQ ID NO: 75940

SEQ ID NO: 117269 - DNA, 201 bp, Bos taurus; identical to SEQ ID NO: 75942

SEQ ID NO: 117270 - DNA, 201 bp, Bos taurus; identical to SEQ ID NO: 36503

SEQ ID NO: 117271 - DNA, 201 bp, Bos taurus; identical to SEQ ID NO: 36504

SEQ ID NO: 117272 - DNA, 201 bp, Bos taurus
ccagagagaggacagaagtgtccctgggggaacacctgggtgtttctcttttatctcaatctaaaccccccaaacacactcacacattgcatgatgatggraaggtcaatcataaactgtgaaacacacataaaaaaatggtaaggtagaaattgctgataatctaaatatgccacttctttgttgaacaggagttctctt

SEQ ID NO: 117273 - DNA, 201 bp, Bos taurus; identical to SEQ ID NO: 75944

SEQ ID NO: 117274 - DNA, 201 bp, Bos taurus; identical to SEQ ID NO: 36505

SEQ ID NO: 117275 - DNA, 201 bp, Bos taurus
gtggctccacttagctggagcttggtccgccagagcctgtttacatgtggccaccagcccttcagtgtcccacctgggtaccacagcagctggactcgagraggaagccaccagctcccttatggcctgtgctcagaggtcccagagtgttattgcttctgccatgttcggaacggtcaggcctatgtcaggcctgccagg

SEQ ID NO: 117276 - DNA, 201 bp, Bos taurus
tggaatcgttcctgctaactgatccccaagtagacaactcagaccaagccagcagagggacctagaaaacagcagatgtgcctcaaaaaagtcaggcaatmtataattatgaatttttaagatcaaaagtgattctaaataactagaagtaatattgtccccctgtgtagcacagttgattaaggacatttttctcggaca

SEQ ID NO: 117277 - DNA, 201 bp, Bos taurus; identical to SEQ ID NO: 36511

SEQ ID NO: 117278 - DNA, 201 bp, Bos taurus; identical to SEQ ID NO: 75952

SEQ ID NO: 117279 - DNA, 201 bp, Bos taurus
gttggtctcatgtaggcagaacgatgcccctggcatcctgcctgcatcacttatcctcacatctttcgtacaacttccagcacctgtgtctaattatctarggccatttactgggcaccagagtccatcttgggagaaggcaatggcaccccactccagtactcttgcctggaaaatcccatggatggaggagcctggtag

SEQ ID NO: 117280 - DNA, 201 bp, Bos taurus
catcgctttgaaatggcgacttttctggatcctccagggctggtcagacgcgtcctgcatggggaacagagttgccttgttctgttccagtgatgcttgcrtttctcctctgctcccacggtgactcctccctgacctgccatgtttacagaaaagaggcaaaagggaaaatgggtcttcagggctgatcagccctgccag

SEQ ID NO: 117281 - DNA, 201 bp, Bos taurus
ctgagcacagggattgagtaagtagactttggatggatgttatcaggaaccaggagcctgcaggttcccaggtttaccctggttctttccctgccttgccrttggcccgtccctgtgcgtcaactcagggtgaagagtcgggcgtgagctttaatctagttccttcccactttgatgtgttgcagcgtggcaagatggggt

SEQ ID NO: 117282 - DNA, 201 bp, Bos taurus; identical to SEQ ID NO: 36512

SEQ ID NO: 117283 - DNA, 201 bp, Bos taurus
aaatgcaaaagtcccgtcttccttggggcaagaggaagttggctgtggctctgtcttctccgctggggaaacttcccacagacagggaacagatgggcctrgatttagataccatctgcttttcagttgtaattaacatcggatccaggggttggttggattttaccattgtgttggccttccccgttgaccgctggggag

SEQ ID NO: 117284 - DNA, 201 bp, Bos taurus; identical to SEQ ID NO: 75955

SEQ ID NO: 117285 - DNA, 201 bp, Bos taurus; identical to SEQ ID NO: 36514

SEQ ID NO: 117286 - DNA, 201 bp, Bos taurus; identical to SEQ ID NO: 75959

SEQ ID NO: 117287 - DNA, 201 bp, Bos taurus; identical to SEQ ID NO: 36515

SEQ ID NO: 117288 - DNA, 201 bp, Bos taurus; identical to SEQ ID NO: 36516

SEQ ID NO: 117289 - DNA, 201 bp, Bos taurus; identical to SEQ ID NO: 36517

SEQ ID NO: 117290 - DNA, 201 bp, Bos taurus
tgccccccaccccggccccggcctttgtgctgcggctcctcctccctccctccagactttgtgcgcctttaagtggcccccaggaagggaccacccagggkgctgcacaatgggggctgaagtagcccctgaaacataggtttcttgagacaggccgtgaaaagaaaagtactgtttaactatgtacatgtttgtcctttc

SEQ ID NO: 117291 - DNA, 201 bp, Bos taurus; identical to SEQ ID NO: 75964

SEQ ID NO: 117292 - DNA, 201 bp, Bos taurus; identical to SEQ ID NO: 36520

SEQ ID NO: 117293 - DNA, 201 bp, Bos taurus; identical to SEQ ID NO: 36521

SEQ ID NO: 117294 - DNA, 201 bp, Bos taurus; identical to SEQ ID NO: 36522

SEQ ID NO: 117295 - DNA, 201 bp, Bos taurus; identical to SEQ ID NO: 36524

SEQ ID NO: 117296 - DNA, 201 bp, Bos taurus; identical to SEQ ID NO: 36525

SEQ ID NO: 117297 - DNA, 201 bp, Bos taurus; identical to SEQ ID NO: 36526

SEQ ID NO: 117298 - DNA, 201 bp, Bos taurus
gcatcactccatgcaacattaggcaagtttggggtgagataaactgaaggatgccctccgctcagcctttgggaattggagactttgtagagacagtggtmtgaactcaggccctgagggacaggcaggagtcagcaagggactaaggaccgggcaaggacggagtgggacagagctcaccaggggaggggtccatgtgtg

SEQ ID NO: 117299 - DNA, 201 bp, Bos taurus
gtgaagtggtttatttgagaggccatccaggaagcacctggtggtcagaggggatttagagggggcagggaagtggccagtgcaggggagtcactgagcaygttgactgttgagggcatctggactccgtgtcccttgagcctcaaggagatggtgcaacacctgtgcaggattgggccgcctgcaggaggggagctgagt

SEQ ID NO: 117300 - DNA, 201 bp, Bos taurus; identical to SEQ ID NO: 36529

SEQ ID NO: 117301 - DNA, 201 bp, Bos taurus; identical to SEQ ID NO: 36530

SEQ ID NO: 117302 - DNA, 201 bp, Bos taurus
cggatgttttccagaccagaacaaggctgcaggtgtttgtgagacatggacacggtttaggttcgcaacaaaggggacactgttagaagtttaaacagcargatctgaaataaaggagctgaagcgggacgtgtgtggaagaggattccaggggaacacgtgtgggcttgtgcacatctgaccaaggcctctggggggaca

SEQ ID NO: 117303 - DNA, 201 bp, Bos taurus; identical to SEQ ID NO: 36534

SEQ ID NO: 117304 - DNA, 201 bp, Bos taurus; identical to SEQ ID NO: 36535

SEQ ID NO: 117305 - DNA, 201 bp, Bos taurus; identical to SEQ ID NO: 36536

SEQ ID NO: 117306 - DNA, 201 bp, Bos taurus; identical to SEQ ID NO: 75979

SEQ ID NO: 117307 - DNA, 201 bp, Bos taurus; identical to SEQ ID NO: 75980

SEQ ID NO: 117308 - DNA, 201 bp, Bos taurus; identical to SEQ ID NO: 75981

SEQ ID NO: 117309 - DNA, 201 bp, Bos taurus
tgcattatgtgattattttatgccatttggactgttttaacaaaatgccacaaatttggtgttttagaaacaatgaaaatttgcttctcacatttctgaarctggaggtctgaggtcagggtgcattcttggtcaggtgagggccctcctccaggcttcttcttgtattttaatgtagttaaggtgggaaggagagttctc

SEQ ID NO: 117310 - DNA, 201 bp, Bos taurus; identical to SEQ ID NO: 36540

SEQ ID NO: 117311 - DNA, 201 bp, Bos taurus; identical to SEQ ID NO: 36541

SEQ ID NO: 117312 - DNA, 201 bp, Bos taurus
gtatactataaatagtcacaactgactctgattcttttgttttcctacatttttttatggagctgtaaaaaaaacctagcacacctagagatgttactgcktacattaaaagggtataaaatgtctttatggaatcccaggaaatcctgaaactaaaattatactattgtattcattcattgactcaacaaatgtttattg

SEQ ID NO: 117313 - DNA, 201 bp, Bos taurus
caagcactgggactcagtgtgtcgggaacagcgatgcaccacggggagacaatggtgagaacatgggaagccgcctccagcgtgacttcaaggccaggctytgtgattcagagattgccttactttaactttgcagaaagctctagtgacaagtgtgtccttgcccttgattatgatgtgatggagggaagaagtggccag

SEQ ID NO: 117314 - DNA, 201 bp, Bos taurus; identical to SEQ ID NO: 75988

SEQ ID NO: 117315 - DNA, 201 bp, Bos taurus; identical to SEQ ID NO: 75989

SEQ ID NO: 117316 - DNA, 201 bp, Bos taurus
aaggggagacagtgagccccgcttggccgtggggaagggctgccctggccggagctcagcccacaccccctgcttccaggacaggacagggacgaagaccrcagtgtggaggctaggtaggccaatgggaaaggccgcacagccgatcctcagtccagtcaactaacagggcacgcggcagtggaccgaggagaacaccaa

SEQ ID NO: 117317 - DNA, 201 bp, Bos taurus; identical to SEQ ID NO: 36547

SEQ ID NO: 117318 - DNA, 201 bp, Bos taurus
ctcctgtctcagaagacaaatggcatggacagaaacgcagactgagcaacacagcatgctcattttcaaaaggcaaagtttaaaaccttcagaagcttttmgatccggcctcatagtcaacaaccagtcagatccctggcagcagccgcggccgtgttgtgctgatgctcctgccctgatgggcgacacgagaggttttgt

SEQ ID NO: 117319 - DNA, 201 bp, Bos taurus; identical to SEQ ID NO: 36551

SEQ ID NO: 117320 - DNA, 201 bp, Bos taurus
gataactctccctctctctcaaatgaaattgctcttctagtttacaaaaataattttgctttcctctgaatttttaccatccttgtatagtcttacactayggtattacctggttagatggcacctttttttctttgcttcatgtgcccacatctttgatacatgcagttgtccattcattcttagggctaagtttgtcaa

SEQ ID NO: 117321 - DNA, 201 bp, Bos taurus; identical to SEQ ID NO: 36552

SEQ ID NO: 117322 - DNA, 201 bp, Bos taurus; identical to SEQ ID NO: 36555

SEQ ID NO: 117323 - DNA, 201 bp, Bos taurus; identical to SEQ ID NO: 36556

SEQ ID NO: 117324 - DNA, 201 bp, Bos taurus; identical to SEQ ID NO: 75998

SEQ ID NO: 117325 - DNA, 201 bp, Bos taurus; identical to SEQ ID NO: 75999

SEQ ID NO: 117326 - DNA, 201 bp, Bos taurus; identical to SEQ ID NO: 76000

SEQ ID NO: 117327 - DNA, 201 bp, Bos taurus
gcagtagatgaaatgcatttcaatgtaactgagaaacatagtaagggtaattaaaggtgcatagacctcacacaaatccactcagtctcattttacccaaygagtaatagggtggtattatccataggggagtatttgtgatattattccacccctacatttctcacttagctttccttaggggattatccataaaaggca

SEQ ID NO: 117328 - DNA, 201 bp, Bos taurus; identical to SEQ ID NO: 36558

SEQ ID NO: 117329 - DNA, 201 bp, Bos taurus
ttctgggaaatagacaatgaaagttgactaggagcagactaattcgactttattttaacttggggaatataaacagtgatttggaaaaaataaacctgcgrtgaatgacttcctgtttcgtgcacacaagggcctgcagaaatatgccacagagcaatttctgggtcagaataaattagagtttgtaatgcatttgcctat

SEQ ID NO: 117330 - DNA, 201 bp, Bos taurus
tctaattcatcacatttacctgcttgaaatatgacactgatctcaggtttttaatcagggtcatggaatggcataagtagggatgggtttttacaaagatrtttgttttctaggccctaacacaagatgtagaatgcaaatttaaaatcttgataataaaacaaaatactaacttgatctagatttgctgaaaatttgatg

SEQ ID NO: 117331 - DNA, 201 bp, Bos taurus
gttgaacctgatacctccccaaatcatggcttgataaatcaataaactgattactgaactcataagttcccttatgtgagaagaagcttgaggaagtgagmctattaaacctggtttggttttagtataaatatggattggacttagtataaattggatttagaaatatccaaaataatggtatctgaactgcatcattat

SEQ ID NO: 117332 - DNA, 201 bp, Bos taurus; identical to SEQ ID NO: 36561

SEQ ID NO: 117333 - DNA, 201 bp, Bos taurus
tacatatataaaaattaaatgactaaaatgcaaacttctgtaggtcgagcatttttatcccctctgcaatgtcaaaacatattagctgctcagttaaaatycactgagaacgttgatttcatttttgaaataaagttgcttaaagcaataatcagaatatagtaagagggaagcttttctaaggagactgggtgcagatgg

SEQ ID NO: 117334 - DNA, 201 bp, Bos taurus; identical to SEQ ID NO: 76006

SEQ ID NO: 117335 - DNA, 201 bp, Bos taurus; identical to SEQ ID NO: 76007

SEQ ID NO: 117336 - DNA, 201 bp, Bos taurus
ctgctcctgtctgaagtgtttgcctgctgatggacacaggtcactctcccaagccccttccttccccacaggccatcaaaatcatttttccacctgcactmggatgaactccaagttcctgtcttcatgtgtctcttgctactaatgattttccctttgtgccagtgagtcatcatccctcaaagttcaagtctcttacag

SEQ ID NO: 117337 - DNA, 201 bp, Bos taurus; identical to SEQ ID NO: 76008

SEQ ID NO: 117338 - DNA, 201 bp, Bos taurus
ccaggggagtcgtgggcaccagagaagctgttactggaatggccatctcgaccatcactatccgagctctgtgccaagttcagagcttttccatggtgctrggaaagggtgacaaaggccttccatctttcataccttctttcagattcgttataggcattcagtaattcaagatatagaataattgaatcgttgcacacg

SEQ ID NO: 117339 - DNA, 201 bp, Bos taurus
ccacgggcccccacttctgccccacagacgggacgctcactgttgacatctgggcccctgccgaggaagatttccctgaggccttcatgccatgaacctartccacacgagaggcagcttctgagctgagccagccttccatatcaagccagctcaggggccagatgcacatgaagacacctgcagatgactccagagctg

SEQ ID NO: 117340 - DNA, 201 bp, Bos taurus; identical to SEQ ID NO: 36562

SEQ ID NO: 117341 - DNA, 201 bp, Bos taurus
atttctgtctgtccaagactgacctgtgaaatgtggacaaaaacaccaccgtcggcccctgcacaccatggcagctgtggaattacaggccttcgggacaraggctccatcaaccaagccggacattgcagcagccgggcagccatgataatagcgggaatgtagctcccccgcagagaccctggggccccctgcttcctt

SEQ ID NO: 117342 - DNA, 201 bp, Bos taurus; identical to SEQ ID NO: 36563

SEQ ID NO: 117343 - DNA, 201 bp, Bos taurus
ttctgacagtctggtgaggcgcacgtcgcactgggcgtcagtgtgctgtggaaccacagcctcaggcgcatcctaggttatgggtgctgagagtcgaaccrgctagcgggaagagtgtgaatgagaggtgcagtcaagagctcttcagggtgaaggagcatgccctttatgtgtgaatcagcatgccctgtccgaggagtt

SEQ ID NO: 117344 - DNA, 201 bp, Bos taurus
gcacccacacctgtggtcctgcctggccaggctgaggccatctgcttcgtgctgagttggttaagatttcaaagaccatccgtaagttcagacttgggtcrggggaggcggtaaggccaccatcatccaactagattagcctccatgtagaccaggctcatcctgtgtgaggaggacaagtggaaagctggacgtgtggct

SEQ ID NO: 117345 - DNA, 201 bp, Bos taurus
ttaagaaggccaagaaaccttttttcttacctcttgggaaacctatattcccttagaaagagaggagaataagaacaaatgcttccagggagttccctagyggcctcatggttaggattccaggctttcactgccatggcccgggttccatccctggctggggaacagatcttgcaagccacagacagacaaacccagtgc

SEQ ID NO: 117346 - DNA, 201 bp, Bos taurus
attgaaaaatgcatttctcaaggagaaaaaaactgtgaaaccaggtacaaaatttattattagagacaaaatacaacaaatgggagagcacacagagaaamagtttgctaatttcagacagaagcagggcagaaatatacatgggagagtgagcctgtgggcagctccctaaggaggaggagcccagtaaagagatggtta

SEQ ID NO: 117347 - DNA, 201 bp, Bos taurus
gacctggtcattggctgttaggccctacatgacctggtcactttctatgtggcttcctgtattccctttgttgtctaatgtcagaaactataactatctarttcacactaggttctctataaattatttgctgaacaaaatatttcttcttttgaaaataagagaaacatagagtttacttcgttagcttctccacatttg

SEQ ID NO: 117348 - DNA, 201 bp, Bos taurus; identical to SEQ ID NO: 36566

SEQ ID NO: 117349 - DNA, 201 bp, Bos taurus; identical to SEQ ID NO: 76014

SEQ ID NO: 117350 - DNA, 201 bp, Bos taurus; identical to SEQ ID NO: 36568

SEQ ID NO: 117351 - DNA, 201 bp, Bos taurus; identical to SEQ ID NO: 36569

SEQ ID NO: 117352 - DNA, 201 bp, Bos taurus; identical to SEQ ID NO: 36570

SEQ ID NO: 117353 - DNA, 201 bp, Bos taurus; identical to SEQ ID NO: 36571

SEQ ID NO: 117354 - DNA, 201 bp, Bos taurus; identical to SEQ ID NO: 36572

SEQ ID NO: 117355 - DNA, 201 bp, Bos taurus; identical to SEQ ID NO: 36573

SEQ ID NO: 117356 - DNA, 201 bp, Bos taurus; identical to SEQ ID NO: 36574

SEQ ID NO: 117357 - DNA, 201 bp, Bos taurus; identical to SEQ ID NO: 36576

SEQ ID NO: 117358 - DNA, 201 bp, Bos taurus; identical to SEQ ID NO: 36577

SEQ ID NO: 117359 - DNA, 201 bp, Bos taurus; identical to SEQ ID NO: 36578

SEQ ID NO: 117360 - DNA, 201 bp, Bos taurus; identical to SEQ ID NO: 36579

SEQ ID NO: 117361 - DNA, 201 bp, Bos taurus; identical to SEQ ID NO: 36580

SEQ ID NO: 117362 - DNA, 201 bp, Bos taurus; identical to SEQ ID NO: 36581

SEQ ID NO: 117363 - DNA, 201 bp, Bos taurus
acattacccttctaaactaaagaaataaatgaaattgtctttgttctagagcagccttaactttaaaatcatcacgacttttgtcagcataaaatatttarattccttaaaatcatttaaattttttttttaaaaaaaggagaactaagttgtagggaaaaaatctacttccctacctctgtgtctaaacatttttgggct

SEQ ID NO: 117364 - DNA, 201 bp, Bos taurus; identical to SEQ ID NO: 36582

SEQ ID NO: 117365 - DNA, 201 bp, Bos taurus; identical to SEQ ID NO: 36583

SEQ ID NO: 117366 - DNA, 201 bp, Bos taurus; identical to SEQ ID NO: 36584

SEQ ID NO: 117367 - DNA, 201 bp, Bos taurus; identical to SEQ ID NO: 36585

SEQ ID NO: 117368 - DNA, 201 bp, Bos taurus; identical to SEQ ID NO: 36586

SEQ ID NO: 117369 - DNA, 201 bp, Bos taurus; identical to SEQ ID NO: 36587

SEQ ID NO: 117370 - DNA, 201 bp, Bos taurus; identical to SEQ ID NO: 36588

SEQ ID NO: 117371 - DNA, 201 bp, Bos taurus; identical to SEQ ID NO: 36589

SEQ ID NO: 117372 - DNA, 201 bp, Bos taurus; identical to SEQ ID NO: 36590

SEQ ID NO: 117373 - DNA, 201 bp, Bos taurus; identical to SEQ ID NO: 36591

SEQ ID NO: 117374 - DNA, 201 bp, Bos taurus; identical to SEQ ID NO: 36592

SEQ ID NO: 117375 - DNA, 201 bp, Bos taurus; identical to SEQ ID NO: 36593

SEQ ID NO: 117376 - DNA, 201 bp, Bos taurus; identical to SEQ ID NO: 36594

SEQ ID NO: 117377 - DNA, 201 bp, Bos taurus; identical to SEQ ID NO: 36595

SEQ ID NO: 117378 - DNA, 201 bp, Bos taurus
aaaatagaggtaaattggtcctctttgaggtgtaaagacctccctctgccccctgggcagtctttttagccacttagcctgattctgaggtcttcttcttrgcaacttgtaattccagatagcagcaagaaatataactgcacctgagcctggagggtttgtgccagggctggagaggtaggggggcatgttcctagaagc

SEQ ID NO: 117379 - DNA, 201 bp, Bos taurus; identical to SEQ ID NO: 36600

SEQ ID NO: 117380 - DNA, 201 bp, Bos taurus; identical to SEQ ID NO: 36603

SEQ ID NO: 117381 - DNA, 201 bp, Bos taurus
caggcgaacagagcacccccaccccctgggttcttcctgctgtgctggcacctctgcaccagaggcagcagtgccccattcctctgcagccaggggcctcytgctgggcagacccaggtaaaggtctggaaagagtgcagaagcacctcagggtgggagtcagtgctgacaccaacctgtctgctgcccttgagcacagta

SEQ ID NO: 117382 - DNA, 201 bp, Bos taurus
agaggcggaaccccgcagcaggtctgatccaggtgcgtccagatagcccccgtgtgggccccacacggacccatgggacccctggcctgggcccgcggtgytggagcgaagccccactgggtatttgtctcctgttggggaattcaagtctgtgctgagaaccgcttagatgtttgcagaggcccagctcctatggcacat

SEQ ID NO: 117383 - DNA, 201 bp, Bos taurus
cccctggactctccaggcaccaccgccctggcgcggccctggtgacgctgtatggagaccgagatgcgccctctgcttaaaggcggctgcatggaggaggrctcctggggtgtcaggggagggcctagtttagccctggtgacaggccaaggcccctctccaccgaccccgcacaattctgggagaggtgacccggccccg

SEQ ID NO: 117384 - DNA, 201 bp, Bos taurus; identical to SEQ ID NO: 36612

SEQ ID NO: 117385 - DNA, 201 bp, Bos taurus; identical to SEQ ID NO: 36613

SEQ ID NO: 117386 - DNA, 201 bp, Bos taurus
tgctgactaggaagaaagaggaaggcccctgctattacttcttttgttttcactgatatcatctctctcccttaacacacgttgatattcagggtggaccrgggggcccccatgggggcttttgaactttatctcctgtaatcctcacgaatggaggaggtggtctttcccacctgtcacagatggggcaagcctgtccag

SEQ ID NO: 117387 - DNA, 201 bp, Bos taurus
catgctcccacttgtgcaacttcagcggcttcctgaaaccatgtggggtgtttctaaaaactacccacatggagcccattcccaggcacccaatgttttakagttctacacagagtaccgattgtctaaacacccatcacggcctgtaattctgtgtgtatatgtggtggtaattgaagatagctcagtttacaataaaat

SEQ ID NO: 117388 - DNA, 201 bp, Bos taurus
taagtccacgaaagaaagtaaaagtttacaatagttcatgaatcatgaaatgcttcagatgccgggagcaaacagcacagcgactcaggctgttcagtgakccctttgtctcctaacaggtggcgggtgcctgctgggacaagacttgggtttcttgaccctctggcagggacatccacgtgcacattttgaatcagttcc

SEQ ID NO: 117389 - DNA, 201 bp, Bos taurus
aagtagaatgattcaccagtgtcgggaagccttgaggacaaagagactgagccgaagggcagcagctgacctcagagcctgggcccttaaggaaagaagtrgtactcacaggacagaccagccagagagaaagctgacctgcattgctcagcagataaagcactggggcagacctccgatgcctctgtttgggcagccaac

SEQ ID NO: 117390 - DNA, 201 bp, Bos taurus
aaaccactttcctaggggacctgatccagtttattgccaaatcatctatatgctaatgaccctgatcttagagttctggccagtccctctccctgatgatycagactcccatccagcatgtgcaatgagatgcaactcacacttaaaatgttccaactggacttttggcccatcactctaaattcagccagtcatctccat

SEQ ID NO: 117391 - DNA, 201 bp, Bos taurus; identical to SEQ ID NO: 36619

SEQ ID NO: 117392 - DNA, 201 bp, Bos taurus
gagccctcaggtcatatttcccagccgaggccaagaatcatgcttcaaaggaaacttgaaggtgagtgaaattaacaaagtttgcggcatatttgaaatcrcaaggatggtcaggccacctgtctttatcctgccagctcctattaaaccatcaaaggcttatttgtgttcctttgatgtgggctgtaagtgtatttcctg

SEQ ID NO: 117393 - DNA, 201 bp, Bos taurus; identical to SEQ ID NO: 76060

SEQ ID NO: 117394 - DNA, 201 bp, Bos taurus; identical to SEQ ID NO: 76062

SEQ ID NO: 117395 - DNA, 201 bp, Bos taurus
ttatctacacaatcttttttattatttgttttggatactttgcttgtttgtgtttgttcactattataaataatactttaatgatctcacacaatcatctytgcacacttttccaattattttcttagggtgaatcataaaagttggatgctagactaacttttaattgttagcttaggtctgtttattttgttgcgttac

SEQ ID NO: 117396 - DNA, 201 bp, Bos taurus; identical to SEQ ID NO: 76064

SEQ ID NO: 117397 - DNA, 201 bp, Bos taurus
tggcctgatctgcttcgctgtttgtacctcctcaggcctttttcccagcagactcgctgctcgctgatcagcagccaccgtggtggtcctgctcagcatcrtaagatgctgtcctgggccccatgtccactctcattcagctctctcctctccctctatgagacaaaggatgctgcgaggctgctagtcctgaacttgtcc

SEQ ID NO: 117398 - DNA, 201 bp, Bos taurus; identical to SEQ ID NO: 76065

SEQ ID NO: 117399 - DNA, 201 bp, Bos taurus; identical to SEQ ID NO: 76066

SEQ ID NO: 117400 - DNA, 201 bp, Bos taurus; identical to SEQ ID NO: 36620

SEQ ID NO: 117401 - DNA, 201 bp, Bos taurus; identical to SEQ ID NO: 36621

SEQ ID NO: 117402 - DNA, 201 bp, Bos taurus; identical to SEQ ID NO: 36622

SEQ ID NO: 117403 - DNA, 201 bp, Bos taurus; identical to SEQ ID NO: 36623

SEQ ID NO: 117404 - DNA, 201 bp, Bos taurus; identical to SEQ ID NO: 76069

SEQ ID NO: 117405 - DNA, 201 bp, Bos taurus
ggtgatggggcttggaacatttaggactctaaaggctggagagtgctcagagagtggagaagcacagaaaactgacctaggtacccttcctttccttcccytttccccattatactataaatgttgagtgaaatgtgactaaaaggcaaaacagtacccaatcagcctgcattgtttgtgatgacaagcactgaggcaaga

SEQ ID NO: 117406 - DNA, 201 bp, Bos taurus; identical to SEQ ID NO: 36626

SEQ ID NO: 117407 - DNA, 201 bp, Bos taurus
gaatcaagtacgttttgaattatgcggcccttgagtgattctgcctcacctctagagaaacgtggtttcctcatgttgtgttctagggatctcatggaagkttgcaaaccgctggccaccatgctggtgaagtccacacaagcccacatatatgtgggtctttatatggtgttttataaatggagccactattctagactc

SEQ ID NO: 117408 - DNA, 201 bp, Bos taurus; identical to SEQ ID NO: 36628

SEQ ID NO: 117409 - DNA, 201 bp, Bos taurus; identical to SEQ ID NO: 36630

SEQ ID NO: 117410 - DNA, 201 bp, Bos taurus
aaacacacagagacaatttgagttttctttctttcccttcaagtttcctctttttggccaactatgtggcttacagggccaaagaggcgctgcaaacttcrggacgtgcacactcccagccttctctagtgtggcgtggcttcatgtctgggtacaagtcctgcacatgtcactcggccagctgatcgggcctcagtttcc

SEQ ID NO: 117411 - DNA, 201 bp, Bos taurus; identical to SEQ ID NO: 36631

SEQ ID NO: 117412 - DNA, 201 bp, Bos taurus; identical to SEQ ID NO: 36632

SEQ ID NO: 117413 - DNA, 201 bp, Bos taurus; identical to SEQ ID NO: 36633

SEQ ID NO: 117414 - DNA, 201 bp, Bos taurus; identical to SEQ ID NO: 76083

SEQ ID NO: 117415 - DNA, 201 bp, Bos taurus; identical to SEQ ID NO: 76086

SEQ ID NO: 117416 - DNA, 201 bp, Bos taurus
gcttcacctgggagtgtccacaggccatacagccagtttcattcggttctctcccaaagacccccaccccctggagaccacaagctcagtcaccaccagtrgggcagcacgatttcttcacctctgaatagtgatccttccacactgagttctgatgcggtactgagcactctgtagtcacttcaaagacatgaccttctc

SEQ ID NO: 117417 - DNA, 201 bp, Bos taurus; identical to SEQ ID NO: 36644

SEQ ID NO: 117418 - DNA, 201 bp, Bos taurus
aaatgattatgaaaaatgattataacgattgcttcttatttctttctggcttttccaatcaatccagctaaaagtcggttgcaaggtgacatgtgcatgtrgggtgtttgacgtgataaatacacaggtgtagagccaagcttgagagcttcggctgttcaaacaccactgttctttcaagaaatactctcttgggtcagg

SEQ ID NO: 117419 - DNA, 201 bp, Bos taurus
ggtctcctgcctggagcggtggcacaggctcagagttctcgggcaggcagagggccctgtggaggcacactggcatttccacgggagagccattttaatamggaattgaaccgctgagtcgaaagttatagagactgcttgctttcttattggtatcattctgttttcttgacttgaaatcagagaacattcaaccaaaaa

SEQ ID NO: 117420 - DNA, 201 bp, Bos taurus; identical to SEQ ID NO: 36645

SEQ ID NO: 117421 - DNA, 201 bp, Bos taurus
gctgctgaaaggggaagccagagatgtggtcatagtttgagtcaatttaagggtaaagaggactttttttttttaaggcagcacttaaggaagccggcctrttgactgatggaagggattcattagagagatgatgggagaaagggacaacgcagttcaggagtggggttggagtaccagggaggggagaggatgggatgc

SEQ ID NO: 117422 - DNA, 201 bp, Bos taurus
ttccacgtgagcacgtgatgcctgggagcaaatgtgaagggtgagtgctttgctgtctgaacttgagatgttgtcacaggcgagcatctgcagaacgttarctctcaacctggtgcttccatgcgcatccactttcattagctttcttcctcttcgtgttcagtggtgtgttttactggggaacacgtcacaagtggacgt

SEQ ID NO: 117423 - DNA, 201 bp, Bos taurus
ccgtcccctttgcagggtttcagcttatgttaattagcacatgtcagaacagagcatgaaaacacataacctgcatcactagaagagtctacaaaggcccytgggttcccctccagcccaggaactgagtgaggcagctgacttaactgttggcagccaccacagtgcagaccagccaggtgtctggccctaggtcaaagg

SEQ ID NO: 117424 - DNA, 201 bp, Bos taurus; identical to SEQ ID NO: 36649

SEQ ID NO: 117425 - DNA, 201 bp, Bos taurus; identical to SEQ ID NO: 36650

SEQ ID NO: 117426 - DNA, 201 bp, Bos taurus; identical to SEQ ID NO: 36651

SEQ ID NO: 117427 - DNA, 201 bp, Bos taurus; identical to SEQ ID NO: 36652

SEQ ID NO: 117428 - DNA, 201 bp, Bos taurus; identical to SEQ ID NO: 76097

SEQ ID NO: 117429 - DNA, 201 bp, Bos taurus; identical to SEQ ID NO: 76100

SEQ ID NO: 117430 - DNA, 201 bp, Bos taurus
atgaactattataaagctacatcatgaatgaaccttgaaaacatgctaaatggaagaagccagacacttagagttaagtattgtgtgattctgcttttatraaatgtccagaataggcaaatctataaagacagaaagcggatgaatagttgttaagacgtggagggggggagtggagagttattaggagtgactactgtg

SEQ ID NO: 117431 - DNA, 201 bp, Bos taurus; identical to SEQ ID NO: 76102

SEQ ID NO: 117432 - DNA, 201 bp, Bos taurus
tgctccatgattgggtggtgtcactggctagattctctgcctgggtagggccacaagctgtgtttaacacttagataaggccataggctgggctgaactayagggcagaactgtaggctagactcagccttgggttgaattctaaggctgcccagggtcactgttcaggctctctggctatgaaggcccagaggcaaaagt

SEQ ID NO: 117433 - DNA, 201 bp, Bos taurus; identical to SEQ ID NO: 76106

SEQ ID NO: 117434 - DNA, 201 bp, Bos taurus; identical to SEQ ID NO: 76107

SEQ ID NO: 117435 - DNA, 201 bp, Bos taurus; identical to SEQ ID NO: 76108

SEQ ID NO: 117436 - DNA, 201 bp, Bos taurus; identical to SEQ ID NO: 76109

SEQ ID NO: 117437 - DNA, 201 bp, Bos taurus; identical to SEQ ID NO: 76110

SEQ ID NO: 117438 - DNA, 201 bp, Bos taurus; identical to SEQ ID NO: 76111

SEQ ID NO: 117439 - DNA, 201 bp, Bos taurus; identical to SEQ ID NO: 76112

SEQ ID NO: 117440 - DNA, 201 bp, Bos taurus; identical to SEQ ID NO: 76113

SEQ ID NO: 117441 - DNA, 201 bp, Bos taurus; identical to SEQ ID NO: 76114

SEQ ID NO: 117442 - DNA, 201 bp, Bos taurus; identical to SEQ ID NO: 76115

SEQ ID NO: 117443 - DNA, 201 bp, Bos taurus; identical to SEQ ID NO: 76116

SEQ ID NO: 117444 - DNA, 201 bp, Bos taurus; identical to SEQ ID NO: 76117

SEQ ID NO: 117445 - DNA, 201 bp, Bos taurus; identical to SEQ ID NO: 76118

SEQ ID NO: 117446 - DNA, 201 bp, Bos taurus; identical to SEQ ID NO: 76120

SEQ ID NO: 117447 - DNA, 201 bp, Bos taurus; identical to SEQ ID NO: 76123

SEQ ID NO: 117448 - DNA, 201 bp, Bos taurus
tacagcagaaaaaatcagttacatttatacatccactcttttttagattctcttcccatctaggttattacagagtattgagtagtttcctgtgctatacygtaggttcctgttagtcatctgttttatgtttgctactgctaagtcgcttcagtcatgtccgactctgtgcgaccccatagacggcagcccaccaggctc

SEQ ID NO: 117449 - DNA, 201 bp, Bos taurus
aacttgcctgccatctggtggggactgacccatcaggggaaaaaaaaagaaagctaagacgcaatcaagaatgagattcctaggccccatataaatatcayttcttccagggagcactcaggtattgaagttactggcttcctccattgtccaccccaacctctgttccagcactgagcgggcacactggatctctttatc

SEQ ID NO: 117450 - DNA, 201 bp, Bos taurus; identical to SEQ ID NO: 76127

SEQ ID NO: 117451 - DNA, 201 bp, Bos taurus; identical to SEQ ID NO: 76128

SEQ ID NO: 117452 - DNA, 201 bp, Bos taurus
aagcaggtacatcataacatgcatgagcagtgctgtaagtggtctcacctgttacataactatgtctttacaaaacgtggagagcaaaaggccctggggcragagagcctgaccaccgccatcttggctaacttgctttccctgcacgtggcacaagccaacctgcacaaccccaccggttgttttagtccctgctacctc

SEQ ID NO: 117453 - DNA, 201 bp, Bos taurus
gaaagactggaaaggcacaagccagaattgtttattcaatggatattgctgcagaatccttgaggcccttctttctagtttccctaccatctgtacttgamtagagcctgtctttccacatatgtaaaatgaaaggagtagattagatcagtgttttcccaagaatgcttttgaaaccactaattactagacatattagca

SEQ ID NO: 117454 - DNA, 201 bp, Bos taurus
ctatctctgccttggttttgggcagcctggctaagggtactggaaaaatgtgtaatgatttgttggttacagttagagaaaagattggccccattgccacmccggattacatccagaatgcacctggattgcctaaaactcgctcaggtatgttcagaggcctctagggattgggattggatgggccaaggcccactaggg

SEQ ID NO: 117455 - DNA, 201 bp, Bos taurus
tggaacccatgtcttcttgcgtctcctgctttagcaggtggattctttaccatggcaccacctgggaagccctcctgtggagcaggtactgttattactcmtgttttatagatgaggaacagaggaccagagggacaggataactgaggatttgcactcacgcagtctgactccagaactcctcaacattgtgctgtattg

SEQ ID NO: 117456 - DNA, 201 bp, Bos taurus
taacaaagcccctttccttagtatgtgtaaggcctttcttttgctactgaacatttctatttaatttctcaaaggcacttccaactccatgatgcccagaygctcatcactttactcaagcctggccctagttcagctctcccaccaggaggcccgtgtgaccttccgccttcacagccaggcctctcatcacccacatca

SEQ ID NO: 117457 - DNA, 201 bp, Bos taurus
ttaaggataccacagctggagtcactgctttcatcaccactgcatggtgccatcttaaagaaattctaccctgtgtcttacactatttgttcaagattcamagtcctggtggaagcattcaaatggccatgcctggatcgtgttgcctttgccatagttacaagggggtgatggagagggaaactttaagcatctttggtt

SEQ ID NO: 117458 - DNA, 201 bp, Bos taurus; identical to SEQ ID NO: 76133

SEQ ID NO: 117459 - DNA, 201 bp, Bos taurus; identical to SEQ ID NO: 76134

SEQ ID NO: 117460 - DNA, 201 bp, Bos taurus
cacactggagtctgggaactcaacctctcatgaccctctgaactccagcagccacagacctcaggaagggccctggaggggaggccctggaggggctgctyacctgtttcctcacatactctaccaacaattcaagttgtcgagggtcttcgcatttctggttgaagaaggttctccagagggcggccgccagcccacggt

SEQ ID NO: 117461 - DNA, 201 bp, Bos taurus
caagtcattaaaatatgccaagtactgtgctaagtctttaccagatcatactgtttaaatcacacactgtgtggtgaacagagaaagaaatgcaaggtaargagactttctcagggtctcaaggccacactacggttgagcaggaattagcacccaggtctgtctggctccaaagcccatgtgatgggaggtaactgcttg

SEQ ID NO: 117462 - DNA, 201 bp, Bos taurus; identical to SEQ ID NO: 76135

SEQ ID NO: 117463 - DNA, 201 bp, Bos taurus; identical to SEQ ID NO: 76136

SEQ ID NO: 117464 - DNA, 201 bp, Bos taurus; identical to SEQ ID NO: 76138

SEQ ID NO: 117465 - DNA, 201 bp, Bos taurus
gttacatttcaccttgctcagcactatccagcttgctgttggctgttgaaatcagctggtttccagggatcgtgtttgttttgtttccacagggtctgtaycacctctccatggacatcatcatgatgaaccgagtgtgtaaaatgttccgtcaaggcctcaggggatttcgggaatatcagatcattgagactgctcaca

SEQ ID NO: 117466 - DNA, 201 bp, Bos taurus; identical to SEQ ID NO: 76139

SEQ ID NO: 117467 - DNA, 201 bp, Bos taurus; identical to SEQ ID NO: 76142

SEQ ID NO: 117468 - DNA, 201 bp, Bos taurus
agatcagagccctgaaggaaacatagttgctgagaaagaggatgggggaggcacctcagggaaagtggggtggaggatgggaaggaggcaggccagggcakattgggaactgcaaggggcaagatcctgaggtgtaaggcgtttggtgtatggagggaactgggacaggttccggtctgaaagggtctgcaaggtcagggc

SEQ ID NO: 117469 - DNA, 201 bp, Bos taurus; identical to SEQ ID NO: 76144

SEQ ID NO: 117470 - DNA, 201 bp, Bos taurus
acgctttgcctgcaagggagattttatgactattacctcctttttatagaggtgctgagagggtaaggaacttgcccaaagtcacacagcaaatccttatyggagactaactgagctgcgtgctggtttttaaagccgtgttgagagtggggaggggtaccatagagttgcagatttcattctttttctttttttagccaa

SEQ ID NO: 117471 - DNA, 201 bp, Bos taurus; identical to SEQ ID NO: 76146

SEQ ID NO: 117472 - DNA, 201 bp, Bos taurus
gtggcatttctcccagcgctggggcactgggggcctttccctcaccaggtatttatgcagcccacccccctccgcttcctcacacaccatgaagggcctcygggacacacatacgagtccctactgtggtccatgtgtccaaactctgtgcacaccttctgccatcctctgccccttgcttttctgtgctcctggaacaat

SEQ ID NO: 117473 - DNA, 201 bp, Bos taurus; identical to SEQ ID NO: 76148

SEQ ID NO: 117474 - DNA, 201 bp, Bos taurus; identical to SEQ ID NO: 76149

SEQ ID NO: 117475 - DNA, 201 bp, Bos taurus; identical to SEQ ID NO: 76150

SEQ ID NO: 117476 - DNA, 201 bp, Bos taurus; identical to SEQ ID NO: 76151

SEQ ID NO: 117477 - DNA, 201 bp, Bos taurus; identical to SEQ ID NO: 76152

SEQ ID NO: 117478 - DNA, 201 bp, Bos taurus
tgggctacagtccaccgggtcagaaagggtcagacatgactgagcacatgcattatagatactgaattattattcttggcttctaaacacattgatcaacrggtatctctgaggaccccaagttccataagttccataaagatctatccaggctacatgctcattgccttcaagacaccagagatcctaagtcctctcgtc

SEQ ID NO: 117479 - DNA, 201 bp, Bos taurus; identical to SEQ ID NO: 76153

SEQ ID NO: 117480 - DNA, 201 bp, Bos taurus; identical to SEQ ID NO: 76154

SEQ ID NO: 117481 - DNA, 201 bp, Bos taurus
aattgaagagcaggattcaaatgcagatttgtctgactttaaagcctagccacagagttcccaaggctgctctcatcataacttttgggctctcttaaaayggatgggataaaggaccaggctggaggggaatgagtctgcactgaccattgactgagtccttgtggggaccccaaggagactaactgatcatttcttcct

SEQ ID NO: 117482 - DNA, 201 bp, Bos taurus; identical to SEQ ID NO: 76155

SEQ ID NO: 117483 - DNA, 201 bp, Bos taurus; identical to SEQ ID NO: 76156

SEQ ID NO: 117484 - DNA, 201 bp, Bos taurus
atgttaggcatgaaaaagagggaattatgggctctatgtcttaaaacactccctcctcctttgcccccaagaggaagagtaggaggaagttccttttgctstggtgaacttcatacctgggagctccagcaagaacaccccggagcttgattaatgtcacctagcgttggaaagcccaggtgacccgtgcccaaccccttc

SEQ ID NO: 117485 - DNA, 201 bp, Bos taurus; identical to SEQ ID NO: 76158

SEQ ID NO: 117486 - DNA, 201 bp, Bos taurus; identical to SEQ ID NO: 76159

SEQ ID NO: 117487 - DNA, 201 bp, Bos taurus
ggggtgggagggactggcaactctgagggaggaggcagaaggaccctgaggctggggcagcaaggaggacccagctggtccccacagggccagcttggctytgccttcccaggcagtgacttcaaagcccttcatcagaagtgagtcaagatgtgtcggtccctggaggtgtccctagccctcggaaggcctctgccaggg

SEQ ID NO: 117488 - DNA, 201 bp, Bos taurus; identical to SEQ ID NO: 76160

SEQ ID NO: 117489 - DNA, 201 bp, Bos taurus; identical to SEQ ID NO: 76161

SEQ ID NO: 117490 - DNA, 201 bp, Bos taurus; identical to SEQ ID NO: 76162

SEQ ID NO: 117491 - DNA, 201 bp, Bos taurus; identical to SEQ ID NO: 76163

SEQ ID NO: 117492 - DNA, 201 bp, Bos taurus; identical to SEQ ID NO: 76164

SEQ ID NO: 117493 - DNA, 201 bp, Bos taurus
cattctcttacactcctgaccttgaattccatttctagcctgggcttcccccaggttctgacctccatatctctgtccctggccaagcaccctgatcctgkctcctaattgctccctttgcttaactgcctgatttaatatccagatcctgaattggccttgggctctgactaattgcagcctagggctcggcagcagggg

SEQ ID NO: 117494 - DNA, 201 bp, Bos taurus
ccgttctctagctgtgactgtgtcctgaaaaactctgaatctgggagaaagatgatttaaacccgctttgttttccacacaaagttctgaaggtatttacrtatttggcccctggtccttcagcatctgcagtgactggcactgccggcgtgttttcttcctagatcatttttattgccagtgtccactgttgctggaaga

SEQ ID NO: 117495 - DNA, 201 bp, Bos taurus; identical to SEQ ID NO: 76167

SEQ ID NO: 117496 - DNA, 201 bp, Bos taurus
gactaagccacactcttgctcccgggaagaggactgctgctgctgctgctaagtcgcttcagtcgtgtccgactctgtgaccacccgacagcaaaaaaggrgagactttgagaagaggccctgcagaaggattgttccagaatgtgtgagaaatctttggtctaacttcacttccctgttcttcagccaggctgtgtctgg

SEQ ID NO: 117497 - DNA, 201 bp, Bos taurus; identical to SEQ ID NO: 76168

SEQ ID NO: 117498 - DNA, 201 bp, Bos taurus; identical to SEQ ID NO: 76171

SEQ ID NO: 117499 - DNA, 201 bp, Bos taurus; identical to SEQ ID NO: 76173

SEQ ID NO: 117500 - DNA, 201 bp, Bos taurus; identical to SEQ ID NO: 76174

SEQ ID NO: 117501 - DNA, 201 bp, Bos taurus; identical to SEQ ID NO: 76175

SEQ ID NO: 117502 - DNA, 201 bp, Bos taurus; identical to SEQ ID NO: 76176

SEQ ID NO: 117503 - DNA, 201 bp, Bos taurus
cttttcttggccattaggatctctgagatgatatggtcactttccctcaaggcttctgtcactaacactttgcctgccggttcttcttttctggtcataaktagggccagaaatgcaggtcccactgggagttgaggtcgtaagggagagaagccagaactttttgattctctgtccttagtcaaatgagacttggagcag

SEQ ID NO: 117504 - DNA, 201 bp, Bos taurus
ggatggaggcaattatggccagcacgcttccattagggccctgccagccccaggtacaggcaacctctgcggggctggttaattatgacacaggacagccrtggggagaggcccatgtggcaggctgggctgcagaacctctgaggccaagcgcattgcagttggtctttactctgggcctgctctgggggactccgtgcc

SEQ ID NO: 117505 - DNA, 201 bp, Bos taurus
ctaaggagtggtgggcaactgaggccctctgtacagcaacccacgaggaagtgaaacctgtcaacaccaaccacaggggtgagcttggaagtggatctgtyggccctagttgagccttgagatgacagcagaccaggctgacacctccactctaacttcaagaatgaccttgagccagaagcacccagctaagctgctccc

SEQ ID NO: 117506 - DNA, 201 bp, Bos taurus
ggcccggagatcatctccaggatgctgcgaggggcactgatcctatctcagctccatcaccaagaccagtggacaggcttgggcacatagtctgatcctgrcttgtcactcactctggccagagtatcaaaagtgagcacagcccggattcttccccaggacctacagacagcagagggtgtcagctgattcattccagtg

SEQ ID NO: 117507 - DNA, 201 bp, Bos taurus; identical to SEQ ID NO: 76178

SEQ ID NO: 117508 - DNA, 201 bp, Bos taurus
tttgtcctctgtcctctgtccctcccccagcttgacatggggaggaccgagggagctaactcaggacggctgatcagggaacttcagaaagaacagagatrgtggtttccctggcctggctgtagtggcgggtttaagaaaataaacaaccaaccaaccagtgacacaataacctgcggtctatttctacttcaagggtgc

SEQ ID NO: 117509 - DNA, 201 bp, Bos taurus
ccccaaccaaggccaaggtaggttggagggggaagttcagagagactgtagtggctctcagatctggctacacaacggactcttatgggctccaattataygtgtggcctggctctgtgcctgaattttctgattcagtagctttaagcaggaccttgacctccccgtctctgcaaaactccagggtttgaaaactcagcc

SEQ ID NO: 117510 - DNA, 201 bp, Bos taurus; identical to SEQ ID NO: 76179

SEQ ID NO: 117511 - DNA, 201 bp, Bos taurus; identical to SEQ ID NO: 36658

SEQ ID NO: 117512 - DNA, 201 bp, Bos taurus
tccaggagcactaagatgctacctaagaattcgggctatccagaggccaccatgctggacagttcacggttggtgctctgaccagtccagcagtgccttcyaatcatccctgcccaggggccagtgcagctgaacccatcttgaaccatcctggccctacagaccagctgcccctccagcagaacacccgagtggcctctg

SEQ ID NO: 117513 - DNA, 201 bp, Bos taurus; identical to SEQ ID NO: 36659

SEQ ID NO: 117514 - DNA, 201 bp, Bos taurus
ttgtgcattttaaatatatagaccctttgatcaccattatctactctccagagttcccatcagtctccaatgaggccccaaaggtgatatttttgtagctmtgtgatgacgctgcccaattccttagtaaaattattcacatacaggccctggacagaattaagaccagcagacttcaatactttaaggcttgaacaagtg

SEQ ID NO: 117515 - DNA, 201 bp, Bos taurus; identical to SEQ ID NO: 76181

SEQ ID NO: 117516 - DNA, 201 bp, Bos taurus; identical to SEQ ID NO: 36661

SEQ ID NO: 117517 - DNA, 201 bp, Bos taurus; identical to SEQ ID NO: 76182

SEQ ID NO: 117518 - DNA, 201 bp, Bos taurus
agggatccatgcagtggactgaactcataactttggcctccttagtaccactgagttgtccaaaaggagatacataagaatcactcttcccacttaacaayatccggcaactgacaagacaatcagagcacacggaccacaggatcagccctctagaatcaggagtctaacttcctgactcccaggtattcccgttgggcc

SEQ ID NO: 117519 - DNA, 201 bp, Bos taurus; identical to SEQ ID NO: 76186

SEQ ID NO: 117520 - DNA, 201 bp, Bos taurus; identical to SEQ ID NO: 36663

SEQ ID NO: 117521 - DNA, 201 bp, Bos taurus
caaagtccttccagattttgacaactgatcatctgatggccctagcttttatctacttctgtaattttgttcccttagcaatactttcattaatgcctctrttgcattctctttttataaagggccacatcaaaccattgacactaattgcgctcaggataaactaaagcccctgatttatttcccacaagtgatgctgag

SEQ ID NO: 117522 - DNA, 201 bp, Bos taurus; identical to SEQ ID NO: 36664

SEQ ID NO: 117523 - DNA, 201 bp, Bos taurus; identical to SEQ ID NO: 36665

SEQ ID NO: 117524 - DNA, 201 bp, Bos taurus; identical to SEQ ID NO: 36666

SEQ ID NO: 117525 - DNA, 201 bp, Bos taurus
aaaaagactaacaaacaaaaaaaagagtcttctctaacaccacagttcaaaagcatcaataccacataactaatgagaggcccatataaagcaggcaaacwgcactgtgagagccctgagaatgtatatttcacaacaggaggggctttggctcttttgctcatcgtgttacttcaaggcctgatgcataacgggtgctca

SEQ ID NO: 117526 - DNA, 201 bp, Bos taurus
cggaaggctggcgggggcggggcaatcagattgtaaacaatggagacctggcctcttacgttcctcagcaaacgcagaagaagaacggccgcatccgatcrccgcgcatcgcggatttcaccctggacctcccggggtttatataccctctgcaacccagggtcggcccctcaacccccgggcctccggggcccagacccg

SEQ ID NO: 117527 - DNA, 201 bp, Bos taurus; identical to SEQ ID NO: 36671

SEQ ID NO: 117528 - DNA, 201 bp, Bos taurus; identical to SEQ ID NO: 36674

SEQ ID NO: 117529 - DNA, 201 bp, Bos taurus; identical to SEQ ID NO: 36677

SEQ ID NO: 117530 - DNA, 201 bp, Bos taurus; identical to SEQ ID NO: 36678

SEQ ID NO: 117531 - DNA, 201 bp, Bos taurus
gatcctgggcctggttcctggtttcacctaccagctgcccaggaagataagaagggctgtggagaagcagagccagatcatctttgtggcattgcaggagraattctgaggaaagatgggggccgactgagctttttgcacccccatctgagggctcaaaagggccaaaaaagaggagagtaatggaagggaggagctggg

SEQ ID NO: 117532 - DNA, 201 bp, Bos taurus; identical to SEQ ID NO: 36680

SEQ ID NO: 117533 - DNA, 201 bp, Bos taurus; identical to SEQ ID NO: 36681

SEQ ID NO: 117534 - DNA, 201 bp, Bos taurus; identical to SEQ ID NO: 36683

SEQ ID NO: 117535 - DNA, 201 bp, Bos taurus; identical to SEQ ID NO: 36684

SEQ ID NO: 117536 - DNA, 201 bp, Bos taurus
tggacattggtgacgccatgggggcacctggcgggggtggtggtgctggtgagggaatcagagggaagtggagagggaaactggccatgagctaccgctgyccctcccaggcaagctcaggggtcctagaacccacgcccaccatagtaaccatggggaaaccgagaggccaggggcagcggattaacctgccaagatcat

SEQ ID NO: 117537 - DNA, 201 bp, Bos taurus
ctggatcacggccggtaaggggtttccatccttctttcctgtctctgcacagacctagggctccggatccagagcgagggcaccttgaatacagacaccayttgtgtatgtgtcgaaggccaacactgtaccagtcacacctgcgaaagttgcacgccccacagcttgtgtctccctggcttcggggtcaagcagatcggt

SEQ ID NO: 117538 - DNA, 201 bp, Bos taurus
gtctgggagttgaggctgatgcttgtggccagttgattttgactctgggtcaaaggatcacaattttggttggaaaatgagacaaagttgagggtggcatyaggggcccaatttgaggatgttcattaggtcttagaagcatctctgacaggatactatcagtataagacagagactcacattttataacaaagttctaac

SEQ ID NO: 117539 - DNA, 201 bp, Bos taurus
gggcaccaagagagtcaaagtggggtggcgtttctgttttgggaaggggggtctgggaaatatcccactgctagatgagatatatgaagaaagacaagacrcaaaggaggtggctcttgagggaaacagccttctgggcaagcgcaaaagccaggagcagaggctggctgggtgtgtttgaggaagagccaggaggcacgt

SEQ ID NO: 117540 - DNA, 201 bp, Bos taurus
ttttactccggcacacagcacgtccgagccacctcgacctctgggccccctgttcagtgaactcagaccagccacctggccacagggagagtcagtctgcktgtctgctgaatggaatcttcctttggttccctcaagggcaggtttgggtaaaggctagcatcacatgaacccaaggccctgttcctttgaattttaacc

SEQ ID NO: 117541 - DNA, 201 bp, Bos taurus; identical to SEQ ID NO: 36689

SEQ ID NO: 117542 - DNA, 201 bp, Bos taurus; identical to SEQ ID NO: 36690

SEQ ID NO: 117543 - DNA, 201 bp, Bos taurus; identical to SEQ ID NO: 36691

SEQ ID NO: 117544 - DNA, 201 bp, Bos taurus; identical to SEQ ID NO: 36692

SEQ ID NO: 117545 - DNA, 201 bp, Bos taurus; identical to SEQ ID NO: 36693

SEQ ID NO: 117546 - DNA, 201 bp, Bos taurus; identical to SEQ ID NO: 36696

SEQ ID NO: 117547 - DNA, 201 bp, Bos taurus
ccaaacgtgtacaggcccttcaattgtctgcaaaaataaatgggggaaaaagtcactgatgcaagtagattcttccaaatatctaaatatttggtattttrgaggcctgtcttgcctggaaatccttccctttctccccatggccgatgtttcaactgagagaccctaacccaaggaatgttctggcatttcattggttta

SEQ ID NO: 117548 - DNA, 201 bp, Bos taurus; identical to SEQ ID NO: 36697

SEQ ID NO: 117549 - DNA, 201 bp, Bos taurus
taacctctgtagccatcagatcgtctcagcccacagatattctagaggccaccatgttttcactatcatagacaaagctgcagtgaacattacgaggtgtkggtcactgggcatttgtctaagactctctcaggtctctagattacagctggaaattgtaaaggtggggacttggggacagggaggcaattgtttccctcc

SEQ ID NO: 117550 - DNA, 201 bp, Bos taurus
gtactgttggctttcacatccatcctcctcataaatatttgtgttgtctctcccagcctcaccatgtcttctggggtcataggagagtctcacgaaacgtrtcagaaaaaaaaaaagaactttatagtgaaatggtagcttccttcacagaggctccacgtaggctgggaacaactgctccatggccgggttaatgagtaa

SEQ ID NO: 117551 - DNA, 201 bp, Bos taurus
gcccttttttccttgtgtctttaggcagcagaaggggtaagggagctctctggagtctcttttttaaggacagtaaccccattcatgagggctccaccctygtgtcttaaccacccaaaggtctcaactcctaattaccagcacattagggggaattagtttcaacatatgcattttgagggacttttgtattttcagccc

SEQ ID NO: 117552 - DNA, 201 bp, Bos taurus
tttggaaaagtagaggaaagggggttggaactgtgagaacaaagctggagtctgtaaaccagggtctgacttaaatctgtgtctgggccgtgccatctctyatctggaccactgcccaagtctcctaactgggctttgggcatccatcctactccctcactctgtgcatcccacttggcagccagggctctttagatacat

SEQ ID NO: 117553 - DNA, 201 bp, Bos taurus; identical to SEQ ID NO: 36698

SEQ ID NO: 117554 - DNA, 201 bp, Bos taurus; identical to SEQ ID NO: 36699

SEQ ID NO: 117555 - DNA, 201 bp, Bos taurus; identical to SEQ ID NO: 36700

SEQ ID NO: 117556 - DNA, 201 bp, Bos taurus; identical to SEQ ID NO: 36701

SEQ ID NO: 117557 - DNA, 201 bp, Bos taurus; identical to SEQ ID NO: 36704

SEQ ID NO: 117558 - DNA, 201 bp, Bos taurus; identical to SEQ ID NO: 36705

SEQ ID NO: 117559 - DNA, 201 bp, Bos taurus; identical to SEQ ID NO: 36706

SEQ ID NO: 117560 - DNA, 201 bp, Bos taurus
agcctgacggtgagagccacggccactcaggagcggcgctcccgaagccccctggatttgtccccccgcccccgaaggacaggcaagccacactctagaarcaagcagtcagtctatgtgggccacagcaaggacaaatggacgtctctccacctgggtatgtgggtttctgatttggacgaaaagtcgctggaaaccact

SEQ ID NO: 117561 - DNA, 201 bp, Bos taurus; identical to SEQ ID NO: 36708

SEQ ID NO: 117562 - DNA, 201 bp, Bos taurus
gggcctggggtccagaggagtgaggaaaatttcacttttcactgtacctttcggactttgaacttggtacctcctccaggggtgctcaattgaagggcttytgtccctcaggagacatctggccatgtctagagacattttttggctgtcacagctgaggagagggtgtccttggaatccagtgggtggaggccagggatg

SEQ ID NO: 117563 - DNA, 201 bp, Bos taurus; identical to SEQ ID NO: 36709

SEQ ID NO: 117564 - DNA, 201 bp, Bos taurus; identical to SEQ ID NO: 36710

SEQ ID NO: 117565 - DNA, 201 bp, Bos taurus; identical to SEQ ID NO: 36711

SEQ ID NO: 117566 - DNA, 201 bp, Bos taurus
gcgtggggggcgtggggccggcatgtgaaaagcaggtgatgagggcgtggtttggggggtgacctggtggggcacggggtcacctacttcctgaggcggcrgggccatgggggacaggagaggaaaatgaggatctgtctgggaaacacggccgcagctgtgtcccatatgggaccccttccaccccatggccagctgcgg

SEQ ID NO: 117567 - DNA, 201 bp, Bos taurus
agctaactgcagaataggctgggaaatataatctctctcagccacatgtgccctgggagcacctccaggttcttgcgttttgaggagaaagatgagggagrttggtaggccctggcagtccctgccaccctcaccctcagcgctgagcacggtcttatctggctcctcatccaccagcccagccagactgtgagctctctg

SEQ ID NO: 117568 - DNA, 201 bp, Bos taurus; identical to SEQ ID NO: 36714

SEQ ID NO: 117569 - DNA, 201 bp, Bos taurus; identical to SEQ ID NO: 36715

SEQ ID NO: 117570 - DNA, 201 bp, Bos taurus; identical to SEQ ID NO: 36716

SEQ ID NO: 117571 - DNA, 201 bp, Bos taurus; identical to SEQ ID NO: 36717

SEQ ID NO: 117572 - DNA, 201 bp, Bos taurus; identical to SEQ ID NO: 36718

SEQ ID NO: 117573 - DNA, 201 bp, Bos taurus; identical to SEQ ID NO: 36719

SEQ ID NO: 117574 - DNA, 201 bp, Bos taurus; identical to SEQ ID NO: 36720

SEQ ID NO: 117575 - DNA, 201 bp, Bos taurus; identical to SEQ ID NO: 36721

SEQ ID NO: 117576 - DNA, 201 bp, Bos taurus; identical to SEQ ID NO: 36722

SEQ ID NO: 117577 - DNA, 201 bp, Bos taurus; identical to SEQ ID NO: 36723

SEQ ID NO: 117578 - DNA, 201 bp, Bos taurus
cacgaggagtgcacatcgtggatttctaaaaagtgccaagaaggcacccccatcccttgaaatgagaagaatgaagatgtctgtgaacacatgtcttggtrcagcttcggaaggtgatgggcgttaggtgttagcaacagcaacagatccgtcccggtgagagacacagcttggaggatctttctgcataagacattttcc

SEQ ID NO: 117579 - DNA, 201 bp, Bos taurus
agaagctccagtttcctttactcacagcctggagtcatttccgttgcctgtgctttaactaaagctgaggggtcagagacgcagaggcctgggacttaccygtgtgggagcgcaggtgcacggtgagctggctggagttgcggctggcgtaggggcagagctggcacttgtagggccgctcgtccgagtggatgcgcaggt

SEQ ID NO: 117580 - DNA, 201 bp, Bos taurus; identical to SEQ ID NO: 76249

SEQ ID NO: 117581 - DNA, 201 bp, Bos taurus
aaggaagctagcccacatgaaagaaatgttgaaatggcatgggttcttggacgatgttgttgaggaaattaataaatccagacgtgaccatgcctctagayttcgagttatagaaaaacatcatttcccttatttcaagtcacagggggttaatgttgtgcttgcagtgaatgcagctcctgtaagcggtgtgtcctggcc

SEQ ID NO: 117582 - DNA, 201 bp, Bos taurus; identical to SEQ ID NO: 36728

SEQ ID NO: 117583 - DNA, 201 bp, Bos taurus
agtggtcagcagggactacttaattgcagttaagcctgtgctgttcattgtggcattgaaaatagagcagcgtgtaatgtggttaaactttctgcctctcygggcccagatgggtgggtggaactcattttttttttttttttggaaacttttaacctggtagcacttatactgaattaagttttactggctatcagcttt

SEQ ID NO: 117584 - DNA, 201 bp, Bos taurus; identical to SEQ ID NO: 36730

SEQ ID NO: 117585 - DNA, 201 bp, Bos taurus
gtcacaaaccccattctcactgaagcccccctgccccagagtggaggcagtcaaagagatatgtaattattctggccttctgcttaaattattttatgccycgggtatgtatttatttgcctgcagcgatttcagaagcatggacaatgcacagatttcactaagagtcactggtgttttcaaatcatggccagcaacttc

SEQ ID NO: 117586 - DNA, 201 bp, Bos taurus; identical to SEQ ID NO: 36733

SEQ ID NO: 117587 - DNA, 201 bp, Bos taurus; identical to SEQ ID NO: 36734

SEQ ID NO: 117588 - DNA, 201 bp, Bos taurus; identical to SEQ ID NO: 36735

SEQ ID NO: 117589 - DNA, 201 bp, Bos taurus; identical to SEQ ID NO: 36737

SEQ ID NO: 117590 - DNA, 201 bp, Bos taurus; identical to SEQ ID NO: 36738

SEQ ID NO: 117591 - DNA, 201 bp, Bos taurus
ataaccttcaagagggggaaagttgaaatatccggttagaaggaccccaaatcgggtaatgagacacgagggtcttgttgccctttagggtttgacacacrtacggcaacctgctcagaatccaagtcctgagcgtcttggacagtggggtcaggttcaaattcactgctgcagctgtgcagcctcgggcaagtcaaccgc

SEQ ID NO: 117592 - DNA, 201 bp, Bos taurus
ctgtcaccgcttttaaaatctgagttccacgtgagcaaggatgtagcctgttctgttcactgccgtgtctgcagtgcagcgcctggcacttcagcaggcaytgaatgaacgtttgttgaacggctacataaatgatccagggggcatagtgccctgaagtgcctgaaagcattcagagggctgctacggccttgcctagtc

SEQ ID NO: 117593 - DNA, 201 bp, Bos taurus
aacataattaaataaaataagaaccgaagctctcaggccagtggcctggaagcactaaatcatgctaacaccagtggacccagaatcaggtccttcacctraggccactgatgccttggctgcagccgcatgaggggtgccgagccagaggctcccagacaagtggtcactcccgatcgtaggatcggtgctgttctcagc

SEQ ID NO: 117594 - DNA, 201 bp, Bos taurus; identical to SEQ ID NO: 36741

SEQ ID NO: 117595 - DNA, 201 bp, Bos taurus; identical to SEQ ID NO: 36742

SEQ ID NO: 117596 - DNA, 201 bp, Bos taurus
agatgctatgtgtctaacacactacttcatacgctgtaaatattttaaaacatacacagaccagctaggcatccagacccagacaaagagcccaggccacrcgggctcgttaattttaaaggcagcgcaaggtgtcctggacaaacgattttcaaagtacatcctgccctgccagaatgcacaatcagcacctcggagcat

SEQ ID NO: 117597 - DNA, 201 bp, Bos taurus; identical to SEQ ID NO: 76267

SEQ ID NO: 117598 - DNA, 201 bp, Bos taurus; identical to SEQ ID NO: 36743

SEQ ID NO: 117599 - DNA, 201 bp, Bos taurus; identical to SEQ ID NO: 36744

SEQ ID NO: 117600 - DNA, 201 bp, Bos taurus; identical to SEQ ID NO: 36746

SEQ ID NO: 117601 - DNA, 201 bp, Bos taurus; identical to SEQ ID NO: 76268

SEQ ID NO: 117602 - DNA, 201 bp, Bos taurus
taaatagagtagtatagcaggtatagtagtataacataataaacgtaacagtttagtggtgggataagtataggataataagtatagtgacggccgcatcmctgattcctgctcgtcccccccgtctccctcttcaggggtcttagccgcatccctgattcctgctcgttcccccccgtctctcttcaggggtcttagtaa

SEQ ID NO: 117603 - DNA, 201 bp, Bos taurus; identical to SEQ ID NO: 36747

SEQ ID NO: 117604 - DNA, 201 bp, Bos taurus
tctgagttatctagggggaagtagggaccagatttaagttttcataattacttttctcaatgctgtaccaagttttttgcatgtagtagggaatcaataartatctgttacattactaaaaggaagaatgcaggtagtcagtgagtatttgatgaattgcttagctgaaccacttacaagctgatttccagtcatctgcgc

SEQ ID NO: 117605 - DNA, 201 bp, Bos taurus; identical to SEQ ID NO: 36749

SEQ ID NO: 117606 - DNA, 201 bp, Bos taurus
agtcatttgaggcagtattttcctggagaaggagcttaaggcctgggtccctttggaaattcttatttcacaggaatgtaaactaccaaggaatgaagacytgagaaatgaaaggcctttggaatcctgatacaagaatacacagcaaacacttgactgaaccccttgaattgctgtgcgcacactcggagcacagaatac

SEQ ID NO: 117607 - DNA, 201 bp, Bos taurus
cagaacaaagaacaccctcaaggtctgggcctgagccacagaaaggggaagtcgccgtttactgagaaggggatatctgggggagggttttgggaaatccragctcagattggccatgttcagtccgagaggcctaatgatgtcttgaaggcaattggtcatatagatctggaactctggaaactagagcttgggaaaaaa

SEQ ID NO: 117608 - DNA, 201 bp, Bos taurus; identical to SEQ ID NO: 76275

SEQ ID NO: 117609 - DNA, 201 bp, Bos taurus
tcactctctgtgcacctgctggcactacgggcatttgtggttgtgagcctgggtgggcagcattcctgggacttggaccttcttgccaagccttgctccayggccgtcatgaactagatcctcccctaaaggctagtccaacgcccccaacctgtttgtaacttgcttctgcttcctcctttttggatgcctgatcattca

SEQ ID NO: 117610 - DNA, 201 bp, Bos taurus
acccgggtgccccggcctcaagaacccctggccacctgctgaaatcgccttgcatcctgtgccccctggtggaaccaaaaccttctgcactgatcacacgyggccgccccctggcgggcatcagttgacactattttcactgtgaaaccccaactgagtgtctccttaggagtttgagtgagtggataacagcaggcaaat

SEQ ID NO: 117611 - DNA, 201 bp, Bos taurus; identical to SEQ ID NO: 76277

SEQ ID NO: 117612 - DNA, 201 bp, Bos taurus; identical to SEQ ID NO: 76278

SEQ ID NO: 117613 - DNA, 201 bp, Bos taurus; identical to SEQ ID NO: 76279

SEQ ID NO: 117614 - DNA, 201 bp, Bos taurus; identical to SEQ ID NO: 76280

SEQ ID NO: 117615 - DNA, 201 bp, Bos taurus; identical to SEQ ID NO: 76281

SEQ ID NO: 117616 - DNA, 201 bp, Bos taurus; identical to SEQ ID NO: 76282

SEQ ID NO: 117617 - DNA, 201 bp, Bos taurus; identical to SEQ ID NO: 76283

SEQ ID NO: 117618 - DNA, 201 bp, Bos taurus; identical to SEQ ID NO: 76284

SEQ ID NO: 117619 - DNA, 201 bp, Bos taurus; identical to SEQ ID NO: 76285

SEQ ID NO: 117620 - DNA, 201 bp, Bos taurus; identical to SEQ ID NO: 76286

SEQ ID NO: 117621 - DNA, 201 bp, Bos taurus; identical to SEQ ID NO: 76287

SEQ ID NO: 117622 - DNA, 201 bp, Bos taurus; identical to SEQ ID NO: 76288

SEQ ID NO: 117623 - DNA, 201 bp, Bos taurus; identical to SEQ ID NO: 76289

SEQ ID NO: 117624 - DNA, 201 bp, Bos taurus; identical to SEQ ID NO: 76290

SEQ ID NO: 117625 - DNA, 201 bp, Bos taurus; identical to SEQ ID NO: 76291

SEQ ID NO: 117626 - DNA, 201 bp, Bos taurus; identical to SEQ ID NO: 76292

SEQ ID NO: 117627 - DNA, 201 bp, Bos taurus; identical to SEQ ID NO: 76293

SEQ ID NO: 117628 - DNA, 201 bp, Bos taurus; identical to SEQ ID NO: 36753

SEQ ID NO: 117629 - DNA, 201 bp, Bos taurus; identical to SEQ ID NO: 76298

SEQ ID NO: 117630 - DNA, 201 bp, Bos taurus; identical to SEQ ID NO: 36754

SEQ ID NO: 117631 - DNA, 201 bp, Bos taurus; identical to SEQ ID NO: 76299

SEQ ID NO: 117632 - DNA, 201 bp, Bos taurus; identical to SEQ ID NO: 76301

SEQ ID NO: 117633 - DNA, 201 bp, Bos taurus; identical to SEQ ID NO: 76302

SEQ ID NO: 117634 - DNA, 201 bp, Bos taurus; identical to SEQ ID NO: 36757

SEQ ID NO: 117635 - DNA, 201 bp, Bos taurus; identical to SEQ ID NO: 36758

SEQ ID NO: 117636 - DNA, 201 bp, Bos taurus; identical to SEQ ID NO: 36759

SEQ ID NO: 117637 - DNA, 201 bp, Bos taurus; identical to SEQ ID NO: 36760

SEQ ID NO: 117638 - DNA, 201 bp, Bos taurus; identical to SEQ ID NO: 36761

SEQ ID NO: 117639 - DNA, 201 bp, Bos taurus; identical to SEQ ID NO: 76305

SEQ ID NO: 117640 - DNA, 201 bp, Bos taurus; identical to SEQ ID NO: 36762

SEQ ID NO: 117641 - DNA, 201 bp, Bos taurus; identical to SEQ ID NO: 76306

SEQ ID NO: 117642 - DNA, 201 bp, Bos taurus; identical to SEQ ID NO: 76307

SEQ ID NO: 117643 - DNA, 201 bp, Bos taurus; identical to SEQ ID NO: 76308

SEQ ID NO: 117644 - DNA, 201 bp, Bos taurus; identical to SEQ ID NO: 76311

SEQ ID NO: 117645 - DNA, 201 bp, Bos taurus; identical to SEQ ID NO: 76313

SEQ ID NO: 117646 - DNA, 201 bp, Bos taurus
tgaggttgtggatccatcatcagctgtacccctgcgaaggtgcatcctgaggacggtcatgtcccgtgtgcaaaggcactggcctcgcctcatcccagcaycttgttcttgcttgtggtcagtggacaggttccctgagatgtgtaattcaacatcagatgagaaaaaaagtataaggacaggcccactagtttctgggct

SEQ ID NO: 117647 - DNA, 201 bp, Bos taurus; identical to SEQ ID NO: 36774

SEQ ID NO: 117648 - DNA, 201 bp, Bos taurus; identical to SEQ ID NO: 76321

SEQ ID NO: 117649 - DNA, 201 bp, Bos taurus; identical to SEQ ID NO: 36776

SEQ ID NO: 117650 - DNA, 201 bp, Bos taurus; identical to SEQ ID NO: 76323

SEQ ID NO: 117651 - DNA, 201 bp, Bos taurus; identical to SEQ ID NO: 76324

SEQ ID NO: 117652 - DNA, 201 bp, Bos taurus; identical to SEQ ID NO: 76327

SEQ ID NO: 117653 - DNA, 201 bp, Bos taurus; identical to SEQ ID NO: 76328

SEQ ID NO: 117654 - DNA, 201 bp, Bos taurus; identical to SEQ ID NO: 36779

SEQ ID NO: 117655 - DNA, 201 bp, Bos taurus; identical to SEQ ID NO: 36780

SEQ ID NO: 117656 - DNA, 201 bp, Bos taurus; identical to SEQ ID NO: 76330

SEQ ID NO: 117657 - DNA, 201 bp, Bos taurus; identical to SEQ ID NO: 76331

SEQ ID NO: 117658 - DNA, 201 bp, Bos taurus; identical to SEQ ID NO: 76332

SEQ ID NO: 117659 - DNA, 201 bp, Bos taurus; identical to SEQ ID NO: 36784

SEQ ID NO: 117660 - DNA, 201 bp, Bos taurus; identical to SEQ ID NO: 36785

SEQ ID NO: 117661 - DNA, 201 bp, Bos taurus; identical to SEQ ID NO: 76335

SEQ ID NO: 117662 - DNA, 201 bp, Bos taurus; identical to SEQ ID NO: 76336

SEQ ID NO: 117663 - DNA, 201 bp, Bos taurus; identical to SEQ ID NO: 76337

SEQ ID NO: 117664 - DNA, 201 bp, Bos taurus; identical to SEQ ID NO: 76341

SEQ ID NO: 117665 - DNA, 201 bp, Bos taurus; identical to SEQ ID NO: 76342

SEQ ID NO: 117666 - DNA, 201 bp, Bos taurus; identical to SEQ ID NO: 76343

SEQ ID NO: 117667 - DNA, 201 bp, Bos taurus; identical to SEQ ID NO: 76344

SEQ ID NO: 117668 - DNA, 201 bp, Bos taurus; identical to SEQ ID NO: 76345

SEQ ID NO: 117669 - DNA, 201 bp, Bos taurus; identical to SEQ ID NO: 76346

SEQ ID NO: 117670 - DNA, 201 bp, Bos taurus; identical to SEQ ID NO: 36794

SEQ ID NO: 117671 - DNA, 201 bp, Bos taurus; identical to SEQ ID NO: 36796

SEQ ID NO: 117672 - DNA, 201 bp, Bos taurus; identical to SEQ ID NO: 36797

SEQ ID NO: 117673 - DNA, 201 bp, Bos taurus; identical to SEQ ID NO: 36798

SEQ ID NO: 117674 - DNA, 201 bp, Bos taurus; identical to SEQ ID NO: 36800

SEQ ID NO: 117675 - DNA, 201 bp, Bos taurus; identical to SEQ ID NO: 36801

SEQ ID NO: 117676 - DNA, 201 bp, Bos taurus; identical to SEQ ID NO: 36802

SEQ ID NO: 117677 - DNA, 201 bp, Bos taurus; identical to SEQ ID NO: 36803

SEQ ID NO: 117678 - DNA, 201 bp, Bos taurus; identical to SEQ ID NO: 36804

SEQ ID NO: 117679 - DNA, 201 bp, Bos taurus; identical to SEQ ID NO: 36805

SEQ ID NO: 117680 - DNA, 201 bp, Bos taurus; identical to SEQ ID NO: 36807

SEQ ID NO: 117681 - DNA, 201 bp, Bos taurus; identical to SEQ ID NO: 36808

SEQ ID NO: 117682 - DNA, 201 bp, Bos taurus; identical to SEQ ID NO: 36810

SEQ ID NO: 117683 - DNA, 201 bp, Bos taurus; identical to SEQ ID NO: 36811

SEQ ID NO: 117684 - DNA, 201 bp, Bos taurus; identical to SEQ ID NO: 36812

SEQ ID NO: 117685 - DNA, 201 bp, Bos taurus; identical to SEQ ID NO: 36813

SEQ ID NO: 117686 - DNA, 201 bp, Bos taurus; identical to SEQ ID NO: 76353

SEQ ID NO: 117687 - DNA, 201 bp, Bos taurus; identical to SEQ ID NO: 76355

SEQ ID NO: 117688 - DNA, 201 bp, Bos taurus; identical to SEQ ID NO: 76357

SEQ ID NO: 117689 - DNA, 201 bp, Bos taurus; identical to SEQ ID NO: 76362

SEQ ID NO: 117690 - DNA, 201 bp, Bos taurus; identical to SEQ ID NO: 76363

SEQ ID NO: 117691 - DNA, 201 bp, Bos taurus; identical to SEQ ID NO: 76364

SEQ ID NO: 117692 - DNA, 201 bp, Bos taurus; identical to SEQ ID NO: 76365

SEQ ID NO: 117693 - DNA, 201 bp, Bos taurus
gacagggatgtatcagccggcagtggacttcccgcaggaccgaagccgctcacagggagggtgggctggaccactgcagaggtcatcgaagaacactatgyggccttttaaatgccaagcaaaattagatcttggggacaacagggtcagacctcttcccgggcatcttgcggttaccctgaacctgtgttttcattagta

SEQ ID NO: 117694 - DNA, 201 bp, Bos taurus
ttaggctcattgagggatcttataaaattataaccctgttttccatagcaccctgcgtagtttccactgggttgggaggtagtccatgaccaaggtctttyggaatgtagtagtaatgtctccagagaaatgaggcagagcatctttttaatgagttcaaagacacatgaatggagaaatttttaaaagttcagacagaga

SEQ ID NO: 117695 - DNA, 201 bp, Bos taurus
aagtatttccgtggagttatagggacgcactttttatgattattattattgattgcaataagtttcagtcccattctaatcctggtatccagggtcttttygaggctggagaatgtacctgcaaccttggacctggctgtatgttttcccaccatttgtccttgaagtgtgaactgcaggaagtttgttctattttatata

SEQ ID NO: 117696 - DNA, 201 bp, Bos taurus
tatttaatgcttccagtgcctgtgcaaaattgtatacacaatggagaagtttttattttcaaaaattccactatgaactccttttattgcaaaagctttcrgacctcctgaaacattggagttgataactggtttgtgactaaatgatccagagttgatcatggtttcatttctgggtgactccagcagtccgaccttttt

SEQ ID NO: 117697 - DNA, 201 bp, Bos taurus
atttacaaggttttagacatgaaagaaaggcagcagattgaaagtgagaatgggagagcactggagaatgaggggtccacagagggtcatgctggcctccyggcaatgctggtccctaccttcaggtgcatcatttgttgccatggcaacttcatggaaataaggaaggtgggcggagcttggcccaggtcctgagttttc

SEQ ID NO: 117698 - DNA, 201 bp, Bos taurus
aactcaaactgttcagcctagactaattgatccatcattaaaagagtggcaactagacatcaccacctccagaggcgatgcaacaagaagacatggcaccrtctatgaaatatcttggactaactgatcttggactgaaagtgtaaaaatacaataacagagtaagttaaacttcaccacaaggaagtaatcaagcaatct

SEQ ID NO: 117699 - DNA, 201 bp, Bos taurus
gtcccatcaatctttgtcaagaaggaagtttcaggggagggtcgagaagggggtcttccgatcctgttttattctttcctcttttgcttcagggcccatgrctgacgactctccttgaataatataaattctgcctgatcttcacatgtccatatctgtaaatatggggccacaagataattaaaacctcttaagaaagtg

SEQ ID NO: 117700 - DNA, 201 bp, Bos taurus
tttttttcattttcagaaatgagatctattatttcaattttaaaagactatctttttcacttgatatcgtcattgttaattcctccaattgtcagctcttrtcatcacatttttggatcagctgttaagtcacatcagcctactgtgctccagccaggcccctgcctcttttgccctctcaggttctcacttccatgagcc

SEQ ID NO: 117701 - DNA, 201 bp, Bos taurus
tctcatagtcaaatgtttatttaatactgacagtatcaagcactgttctagatcttgtcatataaatgtggggtacttgagggttttttcctaaagcagargtgttgatgaccttgtagacttcaggaggaattgaattttgttgaaggactttataccatgctgaggacttgcaaatttgtatactcacgctggaccttt

SEQ ID NO: 117702 - DNA, 201 bp, Bos taurus
taacgattagtgaggttttgtgaaatgacagatagcattcttggattatattcaatttaaaattacaattaaagaaattaaaaatcacttaactccacatytggtgtcaaacctggggcttaacgggtttcccacgcgtctgagaattcattagcgttccttctcctttgttctttctcgtgtcttgacttcatgcttagt

SEQ ID NO: 117703 - DNA, 201 bp, Bos taurus
atggagtttaggaattaagtcactgggtgacatgctaccatcttttgctgaagaccaaactcaaatcctgctctcatttaagtggccttttccagttactytagtgttctatgaactctctaaactgtgactttattttctatccttctcacaaaatccattatgtattccactagattgtacaattcatggggccaggcc

SEQ ID NO: 117704 - DNA, 201 bp, Bos taurus
gagaagcttgcagcctaagacagggaagagttgttactccattggtggtgttgttactccattgtttctccatgaaccttcctatgacataggaagtgacrctgaaataaatcagaagaattgcatctagcctttccaggatggaaaaggaactaaatcctcagatctttctagccaagtgtctgtggaggaagatactat

SEQ ID NO: 117705 - DNA, 201 bp, Bos taurus; identical to SEQ ID NO: 36819

SEQ ID NO: 117706 - DNA, 201 bp, Bos taurus
ataagtaaacacgtagaagcttcctagaaaaaaacaatacgtaaggcggggggcggggggtggggatggtgggctcctggcctttgaaatccacctaaggmgatactaagtgaagtctcctacctgaagtccaccgccctcgccagtggaggaaggcaacgtgtttaaacaggatttgcttgtattaataggcacttctat

SEQ ID NO: 117707 - DNA, 201 bp, Bos taurus; identical to SEQ ID NO: 76370

SEQ ID NO: 117708 - DNA, 201 bp, Bos taurus; identical to SEQ ID NO: 76371

SEQ ID NO: 117709 - DNA, 201 bp, Bos taurus; identical to SEQ ID NO: 76372

SEQ ID NO: 117710 - DNA, 201 bp, Bos taurus; identical to SEQ ID NO: 76374

SEQ ID NO: 117711 - DNA, 201 bp, Bos taurus; identical to SEQ ID NO: 76375

SEQ ID NO: 117712 - DNA, 201 bp, Bos taurus; identical to SEQ ID NO: 76376

SEQ ID NO: 117713 - DNA, 201 bp, Bos taurus; identical to SEQ ID NO: 76377

SEQ ID NO: 117714 - DNA, 201 bp, Bos taurus; identical to SEQ ID NO: 36821

SEQ ID NO: 117715 - DNA, 201 bp, Bos taurus; identical to SEQ ID NO: 36822

SEQ ID NO: 117716 - DNA, 201 bp, Bos taurus; identical to SEQ ID NO: 36823

SEQ ID NO: 117717 - DNA, 201 bp, Bos taurus; identical to SEQ ID NO: 36824

SEQ ID NO: 117718 - DNA, 201 bp, Bos taurus; identical to SEQ ID NO: 36825

SEQ ID NO: 117719 - DNA, 201 bp, Bos taurus; identical to SEQ ID NO: 76378

SEQ ID NO: 117720 - DNA, 201 bp, Bos taurus; identical to SEQ ID NO: 76379

SEQ ID NO: 117721 - DNA, 201 bp, Bos taurus; identical to SEQ ID NO: 36826

SEQ ID NO: 117722 - DNA, 201 bp, Bos taurus; identical to SEQ ID NO: 76380

SEQ ID NO: 117723 - DNA, 201 bp, Bos taurus; identical to SEQ ID NO: 36828

SEQ ID NO: 117724 - DNA, 201 bp, Bos taurus; identical to SEQ ID NO: 36834

SEQ ID NO: 117725 - DNA, 201 bp, Bos taurus; identical to SEQ ID NO: 76389

SEQ ID NO: 117726 - DNA, 201 bp, Bos taurus; identical to SEQ ID NO: 36837

SEQ ID NO: 117727 - DNA, 201 bp, Bos taurus; identical to SEQ ID NO: 36838

SEQ ID NO: 117728 - DNA, 201 bp, Bos taurus; identical to SEQ ID NO: 36839

SEQ ID NO: 117729 - DNA, 201 bp, Bos taurus; identical to SEQ ID NO: 36840

SEQ ID NO: 117730 - DNA, 201 bp, Bos taurus; identical to SEQ ID NO: 36841

SEQ ID NO: 117731 - DNA, 201 bp, Bos taurus; identical to SEQ ID NO: 36842

SEQ ID NO: 117732 - DNA, 201 bp, Bos taurus; identical to SEQ ID NO: 36843

SEQ ID NO: 117733 - DNA, 201 bp, Bos taurus; identical to SEQ ID NO: 36844

SEQ ID NO: 117734 - DNA, 201 bp, Bos taurus; identical to SEQ ID NO: 36845

SEQ ID NO: 117735 - DNA, 201 bp, Bos taurus; identical to SEQ ID NO: 36846

SEQ ID NO: 117736 - DNA, 201 bp, Bos taurus; identical to SEQ ID NO: 36847

SEQ ID NO: 117737 - DNA, 201 bp, Bos taurus; identical to SEQ ID NO: 36848

SEQ ID NO: 117738 - DNA, 201 bp, Bos taurus; identical to SEQ ID NO: 36849

SEQ ID NO: 117739 - DNA, 201 bp, Bos taurus; identical to SEQ ID NO: 36850

SEQ ID NO: 117740 - DNA, 201 bp, Bos taurus; identical to SEQ ID NO: 36851

SEQ ID NO: 117741 - DNA, 201 bp, Bos taurus; identical to SEQ ID NO: 36852

SEQ ID NO: 117742 - DNA, 201 bp, Bos taurus; identical to SEQ ID NO: 36853

SEQ ID NO: 117743 - DNA, 201 bp, Bos taurus; identical to SEQ ID NO: 36854

SEQ ID NO: 117744 - DNA, 201 bp, Bos taurus; identical to SEQ ID NO: 36855

SEQ ID NO: 117745 - DNA, 201 bp, Bos taurus; identical to SEQ ID NO: 36856

SEQ ID NO: 117746 - DNA, 201 bp, Bos taurus
ttgctgaatctgtcaatcaatcacacctccaataacaatcaatcacatccaataactgtaggtcccttgagtcagaggctccaggcccccgtcatttctcyacgagcatcattcaggttacccaggaatcaggatttccaaccatgaagaggttggcccatcagtcattcacagcagttagaactcagccgcgttcatttc

SEQ ID NO: 117747 - DNA, 201 bp, Bos taurus
acaaaccgtcttggtgggcatgggcacaacataagactgacttacataaatgagacaattacagagcagccaagacaatgtatgaacataaaatactgcayaacaaaacgaaaaagtctggaaagcagaagcccacataggctaaaggagcaaggaaaacatggaacagacgttttagaactgggcttgaagaatgaataa

SEQ ID NO: 117748 - DNA, 201 bp, Bos taurus; identical to SEQ ID NO: 76406

SEQ ID NO: 117749 - DNA, 201 bp, Bos taurus; identical to SEQ ID NO: 76407

SEQ ID NO: 117750 - DNA, 201 bp, Bos taurus; identical to SEQ ID NO: 76408

SEQ ID NO: 117751 - DNA, 201 bp, Bos taurus; identical to SEQ ID NO: 76410

SEQ ID NO: 117752 - DNA, 201 bp, Bos taurus; identical to SEQ ID NO: 76411

SEQ ID NO: 117753 - DNA, 201 bp, Bos taurus
ataaggatgtagctatgaaactgtgctggtagtgcaaaggctacttagaaaagtacccttgttgctattagagaacattggatatggtcacagcaaataamaataaggatttttctcttctatggaaggaaaaaagataatattatatgggtctgggaaatcaaatatgctccttaaaacaacccaaaagtaactgctatg

SEQ ID NO: 117754 - DNA, 201 bp, Bos taurus
catttgtgcttggcagcccaggtataggagcaaacagacaacattgtgaagtcagttgtgctgagcaggtgtggcagcagttcaaagcccaggcagtcatrgagtctggaaaaagaatgagccaaccaagttcgaaagcagtgtttctaaacagagatctaaatacagctatataatcacagagctaatgaatgactcatc

SEQ ID NO: 117755 - DNA, 201 bp, Bos taurus
agccttgagccacggactgatccaaacttgggctaacacacatgactgtatcagcaggatgccagtttgctatgcttcttcctggccatttcccaggcagyctcaagaaggttgaaactctgggttgtgtcatgcagtcagtcaactgagatttataaagcacaggccatgtatcagaagtgggggtagaaggattaggaa

SEQ ID NO: 117756 - DNA, 201 bp, Bos taurus
ctagttccctgaccagggatcaaacctagaacccctgcattgggaactcaaagtcttagccactggaccaccaggaaagtccctataattttttgagatgmggatatatcattttcaaagacttaggatgattaagtcatggatcactcagagtttttaccttataagataaaataatggagatttgtcaaggctactcag

SEQ ID NO: 117757 - DNA, 201 bp, Bos taurus; identical to SEQ ID NO: 76412

SEQ ID NO: 117758 - DNA, 201 bp, Bos taurus
gaggagtctggtgagctacagtccatgcggccacaaagagacacaacggagcacacatgcacactggtttccggagctgcaccttctcctgccaggaagtrgggccccctccctgaagtctgatctcctgaaaatgatgcccgccacagagcccgccaaggcggcccgagcatgcgcagagctccccactgaagtcaaaac

SEQ ID NO: 117759 - DNA, 201 bp, Bos taurus; identical to SEQ ID NO: 76427

SEQ ID NO: 117760 - DNA, 201 bp, Bos taurus
agacattcagttcactatcagatataagcatccatttcaggtacaactggttttatgggctgttacctttggtgttaatattcatacatcgggaaagcacmtttatttcaagagaacagataatcatggacatttctccaagtattgaatgtccctgaacttgggaagtttctattattctggaaaatgacttaggaacac

SEQ ID NO: 117761 - DNA, 201 bp, Bos taurus; identical to SEQ ID NO: 76428

SEQ ID NO: 117762 - DNA, 201 bp, Bos taurus
aagagtactagagtggggtgccattgccttctccaagtctcttacacagtttatgtcaaattggtattataatattcttcggtagaatttccttttgtttratgttattatcttggcttgtgatttcctttgtggaatttgagaaataacatttaaatctctttaatttaaaattcataattgccaatattaatttttgta

SEQ ID NO: 117763 - DNA, 201 bp, Bos taurus
accatattctcatataccattttccctattgctaatgttttgttacatgatatagtcaatcacaagtgataaaccaacattcatccactgcaactgaactycatactttattcaggttttattataattttttctagagtccttttttctgatctaggatattatccaagataccacataccatttagtcatcatggctca

SEQ ID NO: 117764 - DNA, 201 bp, Bos taurus
aatttgtgccaatgagagcagcaaacgaaaatgtcagagaaatgtatgcttccgcactacttactgttcctctgaagcattttcaattttactcctaaaaytgactcattaatgctgttctcaggactaattattcattcaaccactggttcacaaatagtcaatgaataattactacatagtaggaactatgcttagtga

SEQ ID NO: 117765 - DNA, 201 bp, Bos taurus
ggttggacaatattatcacctaacattgctatcatctttatatgtagtcaccaagtccaatctacagatgaattagctgttcttaaattaaggactattaycagtcagtaatgatatgacattcttttttatgactatagcttgggttataatgtgacaagaaaaaaaatgtaatgtttccaaaatgacagttttttagat

SEQ ID NO: 117766 - DNA, 201 bp, Bos taurus
gaccaagaaacatgtacaatttatggatgctcaccaaactaattggtgatgtatacctgaccatacaggcttgtccttccatctctgatagaggaagtgtytatgattggcctagggcatcctctgtctgcaagttatcttactagaacctcagctctggtcttttcaaccacactatcagcaaggcaagtctgatgtggc

SEQ ID NO: 117767 - DNA, 201 bp, Bos taurus
actttgattttgccctggtgagacctgtcctagacttatggtctctagaactgtgagataaaagacttaaggatgttgcttaggccactaactttgtgagyatttgttacagtagcaaaaacaaaaacaaaaaaaaaaacccaacaaacaaaccattcaggggccattatcgaaatagagacttcatagcaattttctgac

SEQ ID NO: 117768 - DNA, 201 bp, Bos taurus; identical to SEQ ID NO: 76436

SEQ ID NO: 117769 - DNA, 201 bp, Bos taurus
gtaaacattcatttggaaaacatttactaaatattacatgcttgtcctcctattctaagagcttgtgatatgaacatgtttaagacgttgaacatgcttayagaaaataacatgcatgtgtgtggtgtttacaataaaattggaaccctttgaaaatcttctgattctacctgaaggatcaaggaaatacaaatccagcaa

SEQ ID NO: 117770 - DNA, 201 bp, Bos taurus
taggtgtttcccaatgagtcggcacttcgttgatttttttttacataaataaaaaatgacacttctctggccttctctttgcacttttagtcagtcattgrctggatctgcatgcatgcttccaaaataattgcaaatactgcagacttaataacaagtcaactatctactgtgctatttgtgaaaaaaaaattttaataa

SEQ ID NO: 117771 - DNA, 201 bp, Bos taurus
ctgcactcttgcccattttgagtgttattaaaaacattgaggataatcaagtggaaataaaattttccctaaagattgatgtcacatttgcttgtttatgytttctcttgtgtaaattgttagtttacaaacttcagtgttcacaagcaagatactatttcctctggggagaaagtatatcagacctgtgagtatgaagca

SEQ ID NO: 117772 - DNA, 201 bp, Bos taurus; identical to SEQ ID NO: 76439

SEQ ID NO: 117773 - DNA, 201 bp, Bos taurus
attattcattctaaaaatatgctgagtcaaaggaacatgaaatttgaagggatagaaaaagagggctagacttccctgatgctcaactggaaatttcttcyggtgtcagaacatggctgtgtagcaactttaatcccggtggattttgaaaaaatacaaggatcttcagattttagtagcccctgattactgcctttgctc

SEQ ID NO: 117774 - DNA, 201 bp, Bos taurus; identical to SEQ ID NO: 76440

SEQ ID NO: 117775 - DNA, 201 bp, Bos taurus; identical to SEQ ID NO: 76441

SEQ ID NO: 117776 - DNA, 201 bp, Bos taurus
cttttagtgtctattgcagcgcctctagtatattctttaaaaaatatttctgttgtgattatgggttttgttttcgaaaacagtgaaaagataaatcatakaaggaattaaggaattatggaattcttaaaaatgcaattattaattttggccagatcacaagtttacatggctacagagaccaggtaggtaatgtgcaga

SEQ ID NO: 117777 - DNA, 201 bp, Bos taurus
gggtagcagactaaggaggaattaacaaagtttgtttacaccactttcttagccttgaattccatggctgtactgatgagattgctttcgatactcctggmttagggagcataccttcatgtgggagatttatttcctcctttcaaggggaaaaagttgggtcagagtgtggttgccttaataatttcccctaactgtctg

SEQ ID NO: 117778 - DNA, 201 bp, Bos taurus; identical to SEQ ID NO: 76444

SEQ ID NO: 117779 - DNA, 201 bp, Bos taurus
ctttctatttctatctttctcctctcatgggtcactttgacctcaggtgtcctcggctgtagcttgaagcagggttttggttctaggccagagatttaaakcacgccacagcagtgagagcatggaattctagtcaccagaccaccaggaaccagtggtcggtgactaggccctggcccatgagtggtgtagaaatgaatt

SEQ ID NO: 117780 - DNA, 201 bp, Bos taurus; identical to SEQ ID NO: 76449

SEQ ID NO: 117781 - DNA, 201 bp, Bos taurus
ccctctctcccttccctgccccctcctctttcacacacacacacacacacacttctagcagaagttccaagagacaatgatgcctgaacctgcagcattcyaacacatgtaggtcttctagacatagatccagactagttcaagtaaaatctgctgctttgagggtagttaaaaccaaaggtctcagacactgaattttaa

SEQ ID NO: 117782 - DNA, 201 bp, Bos taurus
gaggagcctggtggactacagtccatggggtcacaaagactcggacacaacttaggaacataacaacagcagtaacagtggcaccatagggccatcaaggmtccacactcctatctccctgctccaacattcttaacccaggagcttccatcttcaaggtcagctcaaaatccattatgatgtgaaggtctagccatcagg

SEQ ID NO: 117783 - DNA, 201 bp, Bos taurus
ggcccttctcattgttgctgtctacttcctgggccttgttactgttttcagtagcagctgagaagacttgcagcttcagatgacacacagccaagctgagrtgggaggccggatgaagggcctgcaccttcctgtgcgtcctcatcagagaagctccacttttattccagccaggacacaatcttctttttttaaaaaaaa

SEQ ID NO: 117784 - DNA, 201 bp, Bos taurus
aaatcatgtaacaaagcactgcagaagtggaggtggggctgagggagaggggcaccaggaactgaggggagcctacataggaataggcagcaagaagctgratcctcaggcctgcagatgaaagggaatgaattctgctaacaaccagagtgaactgagaagtgaattcttccccagtcaagcctcccaatgagaacacag

SEQ ID NO: 117785 - DNA, 201 bp, Bos taurus; identical to SEQ ID NO: 76455

SEQ ID NO: 117786 - DNA, 201 bp, Bos taurus; identical to SEQ ID NO: 76456

SEQ ID NO: 117787 - DNA, 201 bp, Bos taurus; identical to SEQ ID NO: 76457

SEQ ID NO: 117788 - DNA, 201 bp, Bos taurus; identical to SEQ ID NO: 76458

SEQ ID NO: 117789 - DNA, 201 bp, Bos taurus
gaggtgctgaccgctggattcaatgtgcagcggtgttcctccttgattttcaaagtcctgaactgccaacgctccttctcatgtgggagcgcacagaactkcaacagggacctctgccttcccaccttggtggaacaagggcccacatcacagagctcatgcccgctgccaggaacccactgagaatcatcaccatgcttc

SEQ ID NO: 117790 - DNA, 201 bp, Bos taurus
catcaatggtcaatgaatgtttattattatgattacaatatgtcttggtactacctatcaggccaaaaatgtaaataaatccaagccactatttcttaagytatttctgactcaaaattagataacaggtccttaggttgctaccattacatctggagaagccagatttgccatcaaaatatcttgagaaaaccataccaa

SEQ ID NO: 117791 - DNA, 201 bp, Bos taurus; identical to SEQ ID NO: 76463

SEQ ID NO: 117792 - DNA, 201 bp, Bos taurus
tgcattaggtttctcataatagtggaacgatgtatctgctataaaggaagtagttaataataggtaatgcttttgagaattttctaatatgcaggggacaytgttaaatacttcttatgcattaatgattataaagagagttatccttctctttatatatgggcaaaatggacagggagggtccaactctctcaagctcat

SEQ ID NO: 117793 - DNA, 201 bp, Bos taurus; identical to SEQ ID NO: 76466

SEQ ID NO: 117794 - DNA, 201 bp, Bos taurus
ccctagccttctgccttcacctgttccactcctgtgcgtacggccacagtagtctcttcactctagcacaggtcctaacgagctttagaaaaccaccgacyaggaatgtctcggagcctttgtgatgggtcaccaaggcttgcagaatagtttctctgaaaacaattttatcttccttctttggcattagaaaccaaaaga

SEQ ID NO: 117795 - DNA, 201 bp, Bos taurus; identical to SEQ ID NO: 76468

SEQ ID NO: 117796 - DNA, 201 bp, Bos taurus; identical to SEQ ID NO: 76469

SEQ ID NO: 117797 - DNA, 201 bp, Bos taurus
acaacgtgccctcacactgtgtgagttcaccgcacgcagagaactatggaatttcaccccgtattaatatgttgtcttaaggtcctatcatcagatggcartctataaagatggctcctgaaccaagtgctcgcacaactattcattcttcatttacttattccattctaaggatgggaatgctgacggacactgcaaaat

SEQ ID NO: 117798 - DNA, 201 bp, Bos taurus
aaaagtgatggagggagggggtgatggaccgagtccaactggacatctacactgtgatctgcgttcagtttccttcctttaatggctgaaaaatttagagrtcagtgctccttcctcccccagccaagaacagtttcatttttcgctttagttctgtccaccctatcttttcttgcctctatttgccaatttattcaataa

SEQ ID NO: 117799 - DNA, 201 bp, Bos taurus; identical to SEQ ID NO: 76470

SEQ ID NO: 117800 - DNA, 201 bp, Bos taurus
tccagctcattttgcctacaacagaatgatcttcacaatcatctcatagcccttaagggactccttttgctaatgttttcaattaacatcagagactgtgwacaagctggcctttcctggccctcccagtctgctctctcattgcttttcctttacagacttgatcattcacagtttactgcgctgtgtcccttcccacct

SEQ ID NO: 117801 - DNA, 201 bp, Bos taurus; identical to SEQ ID NO: 76472

SEQ ID NO: 117802 - DNA, 201 bp, Bos taurus
tggcaatccactccagtattctggcctggagaatacaatggacagaggcggctgatgggctacagtccataaggtcacacagagtcggacacgactgaaaygactgagcacatgcgcactcagggccaccctcaaacaattaggttccagacatggccgaaaaatactccagttttctgtcactcactgggaaatatttga

SEQ ID NO: 117803 - DNA, 201 bp, Bos taurus; identical to SEQ ID NO: 76475

SEQ ID NO: 117804 - DNA, 201 bp, Bos taurus
caacattagtttgattatccatgaagggaagatgttaccaagccatccaggcccttattccaaaagcaaccagcaagtgtaaacccggcctcttttccctkcaaaccacggaccatgcgacattcgggcagcacatgcttagctatggatgtactttctcctctctcagtccaggccttctagatacctttgcctacatct

SEQ ID NO: 117805 - DNA, 201 bp, Bos taurus; identical to SEQ ID NO: 76476

SEQ ID NO: 117806 - DNA, 201 bp, Bos taurus
ctctttgcctttgcttggacctctcttgaaatggtggtctgtcctcccatctgtgctcccatctgatctgctttactaggttataaagtctttaaagccartggtgacccttaggcagagttggtatctaatgacttgaattgatgctgaagatcctggcctgtgttcagcagttgagtcacacaggcagtgggacagcag

SEQ ID NO: 117807 - DNA, 201 bp, Bos taurus; identical to SEQ ID NO: 76477

SEQ ID NO: 117808 - DNA, 201 bp, Bos taurus; identical to SEQ ID NO: 76478

SEQ ID NO: 117809 - DNA, 201 bp, Bos taurus; identical to SEQ ID NO: 76479

SEQ ID NO: 117810 - DNA, 201 bp, Bos taurus; identical to SEQ ID NO: 76480

SEQ ID NO: 117811 - DNA, 201 bp, Bos taurus; identical to SEQ ID NO: 76481

SEQ ID NO: 117812 - DNA, 201 bp, Bos taurus; identical to SEQ ID NO: 76482

SEQ ID NO: 117813 - DNA, 201 bp, Bos taurus; identical to SEQ ID NO: 76483

SEQ ID NO: 117814 - DNA, 201 bp, Bos taurus
ccaactcgtagcgaccccatggactgcagcctaccaggctcctccgtccatgggatttttcaggcaagagtactggagtgggttgccattgccttctcctrgggaagacctcaattctggccactctcattacatcacagggtggcccccgggttttgtttacatataaggccccatgtttaatatgctgagctctgtgta

SEQ ID NO: 117815 - DNA, 201 bp, Bos taurus; identical to SEQ ID NO: 76485

SEQ ID NO: 117816 - DNA, 201 bp, Bos taurus
gtcactgatgcttctatcatgcagtaaacccagaaaattactatttgttgaaatttctcactgcttcaatttatgcagaaatataatacagttttatgagyctggagtatttctggttacgagagaagatggctatgtttgatttcaaggccatttggtcacatttctaacctgttaatttttttttccaattttttcact

SEQ ID NO: 117817 - DNA, 201 bp, Bos taurus; identical to SEQ ID NO: 76540

SEQ ID NO: 117818 - DNA, 201 bp, Bos taurus; identical to SEQ ID NO: 76541

SEQ ID NO: 117819 - DNA, 201 bp, Bos taurus; identical to SEQ ID NO: 76542

SEQ ID NO: 117820 - DNA, 201 bp, Bos taurus
agccctcacagctgctggtgcacctgcagctgcgaccgcagcccctccgcctgccctggttccaccactgtgtgtgtttgcagctggccccgccacagccragtgtgtgttcacaacaggctccagccactactgctgcctgccttggtccctagcctctgaactggggctcacctctgagaaccccaactgcccttgtgg

SEQ ID NO: 117821 - DNA, 201 bp, Bos taurus; identical to SEQ ID NO: 76543

SEQ ID NO: 117822 - DNA, 201 bp, Bos taurus; identical to SEQ ID NO: 76545

SEQ ID NO: 117823 - DNA, 201 bp, Bos taurus; identical to SEQ ID NO: 76546

SEQ ID NO: 117824 - DNA, 201 bp, Bos taurus
gtttgctcagttcctaaagctagattttagctttggctgtgactagtatgccagttctccccttatcttgcagtgtcagctgtacacccacccctttcctkgcactcttgcttaggataactctttcctttctgaactttcacaaccagtctaatacttactgtgtacctctcaaactggcctacttcctccctaagtagg

SEQ ID NO: 117825 - DNA, 201 bp, Bos taurus
gtaagtctagaaattatacttgacagtataacattattttggtatatatctatgtaatataaatgcacatcaacttcaggataatggttaattttggtgcragtttggagggggtgtttttagataacattttatttcataataaaaaaaacaaattcaaagcaaatatgtcaaaatatgacatctgctaagttttaatgg

SEQ ID NO: 117826 - DNA, 201 bp, Bos taurus
tttctaatttctccttttttattggccttttggccttaaataaaatctattaggttctcatagataaatatctagtactgtaatgttagacacttaactayacaggacagaatttagactctattaaagattagttcagagtgctgagaagaatttcaggagcgttcccattttaaaactatttcttttgcagtggaggag

SEQ ID NO: 117827 - DNA, 201 bp, Bos taurus
tacatccctcactttcccacaaagactaacaatggacctggagcacatagaaattttatcaaaagaggagagttcagacatcagctagtatggatgggacycactgtattggaaaaatacagtgtattggaaaaatactgaatggggaaaggaaaagtcaattcgcaaaaaaaaagagagagagagagagacttttgaaat

SEQ ID NO: 117828 - DNA, 201 bp, Bos taurus
tgcagctcctcctggcaggcctgctggatggaattgatgatctcaggcaccttggccacccagctgaacaatggtgagatcaagggccaggtggtggctcrttgtcccgggctcccgcttactcccactgcctgccctaggggtggcggggagtcaggggccagcttggggtgcagcagggcggggcatggctcccctggc

SEQ ID NO: 117829 - DNA, 201 bp, Bos taurus
tgagctgtgtaatcagagagcaagctgagagaggccagagaaagtcccaaccccaaaagggcgattttctgtccaatctctacagtctagaatacagatgyctaggccctcatgtcaacccttcagattctgtaactctgtaaaagacgctagaaaaggttactggattctgattcaaaaacagagttaatctattctcag

SEQ ID NO: 117830 - DNA, 201 bp, Bos taurus
tggccacctgtgcggaagacttcgtgggagtccagcctttctgaggggagagtctggcacaccacagaagcaagatggagatagatgagtttggatgatasgagaggaaggaatgggccaagatgccctctccccagggcaacactggaaatggctgggcttttggctgcagaggtcttccccggtggctcaaacagtaaa

SEQ ID NO: 117831 - DNA, 201 bp, Bos taurus
ggacagaggagcctggtgggctaccgtccattgggtcacacagagtcggacatgactgaagcaatacagcacgcttgcatgcatgcagtgatgaagaaagmaagaaaaaactgagcatggtgattcgtctcctatcaccctttgcagtttatgaaagacttcggtatatattactaattctcacaccaagtccatgacaaa

SEQ ID NO: 117832 - DNA, 201 bp, Bos taurus; identical to SEQ ID NO: 76551

SEQ ID NO: 117833 - DNA, 201 bp, Bos taurus
aaccattatataacatcagtacagggtcttccaagacaactcagtattcagtctttacattgtaagttctatacattgtacatggcccagttgtttaagayaccaagatccaaccagattttggaaaaccatttgcctgtcttaggatcagcataataaaaaattttcaaagagaggcctttgtcaaccacctcatcagtc

SEQ ID NO: 117834 - DNA, 201 bp, Bos taurus; identical to SEQ ID NO: 76552

SEQ ID NO: 117835 - DNA, 201 bp, Bos taurus; identical to SEQ ID NO: 76553

SEQ ID NO: 117836 - DNA, 201 bp, Bos taurus
ttttttaacagtagatgcaaacatctacttgtaaatggccatttttacaactgccaccgctagggcgctgccacagacactttcgcttggcccacccaccwtttattttcaaccctctcttcctgacctctttctgggctgtcatgaaatagtagcagggtcctatagtaagattcttggaaaacttctgttttcctgatc

SEQ ID NO: 117837 - DNA, 201 bp, Bos taurus; identical to SEQ ID NO: 76555

SEQ ID NO: 117838 - DNA, 201 bp, Bos taurus
tggaggggtagagaacacaaagacagtgcttcttatatatatttataatgaagaacttttctagttccagagcctggagtctccagttcattttaatatartaagttttatattaactaggtgcataaaaaggacaacctcttcctgtactggtttgtcatcatgttacatttatccagtactgttttgaacctactcata

SEQ ID NO: 117839 - DNA, 201 bp, Bos taurus; identical to SEQ ID NO: 76557

SEQ ID NO: 117840 - DNA, 201 bp, Bos taurus; identical to SEQ ID NO: 76558

SEQ ID NO: 117841 - DNA, 201 bp, Bos taurus
aagggccatcattagaaagtcaacaaataacttctggagtggagaaaagggaacatgtctagactgttggtgggggtgcaacatggtgcagccactgtggyaaacagtacgggggccctcagaaaaccgtaagtactattaccatatggtccagcaatcccactcctgggcacatatccagacaaaactctagtttggaaa

SEQ ID NO: 117842 - DNA, 201 bp, Bos taurus
cacgtgctgatccatcaggagtgccaaacaatctattgcaattttcagctgaagctccctttcaaactgtgaacaaggctaaaatagcatgcagccattcrtatgagtaaaattccattttcatacaatcatcgccactaagactgagaactagtaggtaactattttgtgtcacatattgtatactgataatctcacaaa

SEQ ID NO: 117843 - DNA, 201 bp, Bos taurus
aggaaatgaggttgaatttaaaaatttttttcattcattcgtccattcattcagctaatattctttgagtgtttgctatgtgccaggtactcttgcagcarctagaggtatagaagtgaacaagaccaggttctgttcactaagcttagattctagtgagaaatcaatttaataaaaaagtatatatactaagaaatcaat

SEQ ID NO: 117844 - DNA, 201 bp, Bos taurus
atcttgttcttgatattggaggaaagcttttaacctttcaccattgagtatgatgctatttgggggcttgtcatatatggactttattatgttaaggtgtrttccttctatattcaatttctggagtgtttataataaaagaatactgaattttgtcaaattttttttctgtttctattgagatgttcatataattttagt

SEQ ID NO: 117845 - DNA, 201 bp, Bos taurus; identical to SEQ ID NO: 76561

SEQ ID NO: 117846 - DNA, 201 bp, Bos taurus; identical to SEQ ID NO: 76562

SEQ ID NO: 117847 - DNA, 201 bp, Bos taurus
tatactagcagggcatttccaaaacataccagagtaacacaagaaagaaagaaatgtgcaggtaaagaaattatccattggaagtttttgatttttaaaamtttttggaggtttttattacagtaggtgactgtgagatgaaatcatttagtcatgtccagctctttgtaaccccctggactgtacctctattcatggaat

SEQ ID NO: 117848 - DNA, 201 bp, Bos taurus
gagagcacggtttgcaccatgtgaaaatgagagtgaaacccccgagggcggctcgctgaaatatgtgcaaaatgaaagaagccctccccaaggcctgcagygtttctcccttctcctcttcgatctgcaaaacaccggatttcactgctgccagagaaaataccggggtcagcgccccgggccctgggcccttccaaatgg

SEQ ID NO: 117849 - DNA, 201 bp, Bos taurus
aagtacgagggtccagataaaagggaaagagccttgaagaaataaagggggagatttaagaaatagtgggaaaagtcccaaggaggtgggtttctgggccyggaactgatgaaggggctggcatcaccttgcagacttgtttgaccacagcagaccatggtcagtgatggctgggtcttcccttggccgtagactctttac

SEQ ID NO: 117850 - DNA, 201 bp, Bos taurus; identical to SEQ ID NO: 76576

SEQ ID NO: 117851 - DNA, 201 bp, Bos taurus; identical to SEQ ID NO: 76577

SEQ ID NO: 117852 - DNA, 201 bp, Bos taurus
gagatataacactcaggccacaacaggttctaaatgtttttcttttaacgatgaaaaggagatggtcttcaaatatcagcatgatgtctagttaaaagtaygggtacagaactttagctggccgactgactgagtcaacgggagaaataatggaaaaggagtgtggattcagagagccgagagagcatgcttgtgtggaaa

SEQ ID NO: 117853 - DNA, 201 bp, Bos taurus
gctcttcatttactccctcttcatcccaaggaatctagagtcacctctagctttcatcaagcatctaggagaccctactagaaggccctcaggtgacctcmcaccagtcctcacacagccccctgtccactttgtcactggaaatatgcaagcgttctttgcactgatgagctctgggagtgcaggcccatctgcttccag

SEQ ID NO: 117854 - DNA, 201 bp, Bos taurus; identical to SEQ ID NO: 76581

SEQ ID NO: 117855 - DNA, 201 bp, Bos taurus; identical to SEQ ID NO: 76582

SEQ ID NO: 117856 - DNA, 201 bp, Bos taurus; identical to SEQ ID NO: 76583

SEQ ID NO: 117857 - DNA, 201 bp, Bos taurus; identical to SEQ ID NO: 76585

SEQ ID NO: 117858 - DNA, 201 bp, Bos taurus
caaagggacaaaaacaatgaaaaataaacaaaagatcaaggatgaaaaaagaatttcttcctcaaatgacagaggataatgctttatacaaaaaacaaggrcaaagaaattgtgacacccttggggcacactgccttcatttgtacagcaaaattgctattttcttaatctagaatcaaattatgagggcttgatgagtat

SEQ ID NO: 117859 - DNA, 201 bp, Bos taurus
tttattgaatatgtactacatggtaggagtacaacagtgaataaatagacatgtctcaataccatggagattaccttctggttgggtatttctaagaaggraacatttaagctgagccctaaagaactaggaagaggcagtcttacacaagagaaggggggttccatggagagaaaatggcatgcacaaacccctggggtt

SEQ ID NO: 117860 - DNA, 201 bp, Bos taurus
tcaaagagtaactagaaagtagacagagcacatagaatcatattacaaatatcacaagagggtagagcagatctcaagtctccaagatcgcaaagaacttkgtcgggttgagccactgaaagaccagtgaggcaggagcacagcaagagagaagagtagcaagaggccagacacggttttgtgagccatgatgagagttcg

SEQ ID NO: 117861 - DNA, 201 bp, Bos taurus
agatgctaggtcactggccacttcgcagggtcccaccatcctgccaacgtcttggccatccctctagtgcacggctgtgtgcctccggccctggagcccaygtgtccactctcactgggctctctgtggactctgggacaggctccatgtggggctgcccggcaggcaggctggcattacctaattgccggccaaggtctt

SEQ ID NO: 117862 - DNA, 201 bp, Bos taurus
ggatcttctctacctctggatggctaccgtaaggaagaaattaattttcttccctgaggctggccattccaggagatatttgcaagattaatggccttttyactttaccacctcacctcacccctatctgttctataaaagatcctggcatccagacttcaataagatggttatttggagacattagtctgccatcttctt

SEQ ID NO: 117863 - DNA, 201 bp, Bos taurus; identical to SEQ ID NO: 76586

SEQ ID NO: 117864 - DNA, 201 bp, Bos taurus; identical to SEQ ID NO: 76587

SEQ ID NO: 117865 - DNA, 201 bp, Bos taurus; identical to SEQ ID NO: 76588

SEQ ID NO: 117866 - DNA, 201 bp, Bos taurus; identical to SEQ ID NO: 76590

SEQ ID NO: 117867 - DNA, 201 bp, Bos taurus
taaggaaggacatgtccacaccttgacctggttctgaaaggaggggaagaaacgaaacctcattacattagaaaacaactcgccctcgggcagcggcctcrattaggttacctgttaatactgtcatttgctaactggattccacagtctatttgcaacactgttttataatccacgtaagctttctgatactgctctaca

SEQ ID NO: 117868 - DNA, 201 bp, Bos taurus
aacctgatttatagtaacagcaaagagctaaacaattacttgtatttgaaattagggctttgtagagttttaataatgatggtaataatttatgtaccttytccatctgcagttgtggaagaactgtgtgtacttttggtttgacctacaagcttatcatcagcttttctaccaagaaacccttcacccttttaaagtatg

SEQ ID NO: 117869 - DNA, 201 bp, Bos taurus
agttggtgtatatacaaagattcagtagaaatttgttctaatcttggatctgttactgtctttctgatatagagccatttatttttgccttttttggtctyagtttacttatgtataagaaacaaagcgtccttttttagcactaatatgtaattctgtgagtttatgatattggagattttttaatctgtaactgtatat

SEQ ID NO: 117870 - DNA, 201 bp, Bos taurus
catgccagcctcgaatttcctctttcttaagggtctatttcctctacgaagccctttcctttatgaatccataatgattgttctctctccttcagtcctayaggatatacttgatcttttatctggtacttagcatttgctgttttctgttactattttctcttaattcttacactctcttaattagattgtaggattctt

SEQ ID NO: 117871 - DNA, 201 bp, Bos taurus
taggatctttcaataaattgctttttctacttttaattcctttggtttctacaaatagtttagtatctcttttgttaaaaaaatactcttattcttttgtkatcatttttaatttcctagttttaatatttctggcattctatttgacagctgcctccttttcagtttctttagtttcacaagcatgttcatttaaccttt

SEQ ID NO: 117872 - DNA, 201 bp, Bos taurus
agttaaccaacagtacaacagaatacttaggaataaaaaaaataaattatagattcatgcaaaaacatggattaatctcaaaatcacaatactgaatgaargaagctaggcaagagagagcaagagagcacacctgtaatgattccatttatacagaatccgagcaaatgaaaattaatcagtaacagtatcagtgattac

SEQ ID NO: 117873 - DNA, 201 bp, Bos taurus; identical to SEQ ID NO: 76595

SEQ ID NO: 117874 - DNA, 201 bp, Bos taurus
tccatggggttgcaaagactcagacacgactgagtgactgaactgaactgaattttttttcacttgtaatcataagataaatattggaggtggaatataamaagtgtcaaggccttaaaatatagaattgtctgagctgaggtgtggtaagtggtaatgagaaatctgttcccacctgccatctgaacatctgggttatag

SEQ ID NO: 117875 - DNA, 201 bp, Bos taurus
aaaagtctgactagtttaaaattttacgctcaaatgtgatttaaatctcacctgatcattccctaccctgtgtctcaggacaggccaccacagtggtttargatagttggtatgctttctcctctgctgggtctcgctcttggggagatgggcagtgagagggaaggggtgaggagcaggctagaggaaggccagaagagg

SEQ ID NO: 117876 - DNA, 201 bp, Bos taurus
cagcccaacgtatcaacactgccaaggttgagaaacctggaacagactcctagagccttttcctgtgccctctctcttccctatcccttcttttccttcaygagggccactccccctggtgtagtgattgtgccaggccagcctctctcagggcttccccggtggctcaggaggtaaagcgtctgcctgcaatgcgggaga

SEQ ID NO: 117877 - DNA, 201 bp, Bos taurus; identical to SEQ ID NO: 76597

SEQ ID NO: 117878 - DNA, 201 bp, Bos taurus
tcagcctcttctctagcttcttcttctccttctgttcccggatctggctcttgaatgggtcgctgtgcttgggctcctggggcccatggtacagccaatcrcgggagagctgcaggagatcctcctcggctgggacgcagatcagggtgtgcgggccagggctgcccttccccagcagggccagcctgacccacaccaggg

SEQ ID NO: 117879 - DNA, 201 bp, Bos taurus
cctggagaatcccagggatggaggagcctggtgggctgccgtgtatggggtcgcacagagctggacacgactgaagcgacttagcagcagcagcattggtrtttaagctataaaacttctggaagaagtctgcaagaaatgggtggcatttttatcaggaaagagtgggacagtaattacactgagaagcagagggctggc

SEQ ID NO: 117880 - DNA, 201 bp, Bos taurus; identical to SEQ ID NO: 76598

SEQ ID NO: 117881 - DNA, 201 bp, Bos taurus
tgaagaacctatgactcagcaatgtctgcctcctctcttcacacaggcagggtatgactagaaaatggcggctataccgtgtgtgtatgtgtgtgtttgarggccatcgcctctcacaatcatcctgtacatgatagaatcacaggagttagtagtgaacttgtgggaatgacagtcatttgaatgtcagacctggggaac

SEQ ID NO: 117882 - DNA, 201 bp, Bos taurus
gctttacgtacccccaggcctcggctctaccccctttctctctctctctctgaggacctccggtacagggaacttgccattcgaccgctctacatgcaacrctccactcaggccaacccctagactaaggtaagatcccgacggtgttctagaggcgccctagaacccagtcctctccgggtcccggggaccccggcctaa

SEQ ID NO: 117883 - DNA, 201 bp, Bos taurus; identical to SEQ ID NO: 76599

SEQ ID NO: 117884 - DNA, 201 bp, Bos taurus
ataagatctttaccagttactaatgtacagaactttccagcctaaaaggcctagtggcacaaatagctattacactgtcaaatcctgagtgacaataaaartcctggaattaaccccaatgtgcattaaaggctgcagctactgcatctgcagcctagacacatttctgaaaaaccttataaaaaaaagggctacaatact

SEQ ID NO: 117885 - DNA, 201 bp, Bos taurus
gaaccaaaaagagataaccatgaagataaagcctatatgttaaggaatgcaaagtggaaagatgcaaaaacccaaggtcctaaagacactactgagatacyagaactatcctatatctggacatttgttattgagataacatgtctttattgattaagcaatcattagatttgcttacagttttcagttattcattgatga

SEQ ID NO: 117886 - DNA, 201 bp, Bos taurus
acgggacttaataactcactgggcctgtgtgaactgagattttcctggtaaaacgccttgcctttatcagtttatattttaaagcttctgtttcaggacargaggaaaacctattttcacaaaggccaagagggtagcctcttcatctgcaaagagaaagccactacagaatgaataaacaattgataaagcttttcaaat

SEQ ID NO: 117887 - DNA, 201 bp, Bos taurus
cagaacctaattcgggacaagggattagcactgccacgtggcccgggtctaaagccatctgctccactgagcttgaaccaggaagaagtcagctgatgttktacactcttctttcccgcattttcaaaaccagactggagatggggcatgatgttcactgacccactaaagtatcagttgagatcaggtagttcctctgct

SEQ ID NO: 117888 - DNA, 201 bp, Bos taurus; identical to SEQ ID NO: 76605

SEQ ID NO: 117889 - DNA, 201 bp, Bos taurus
agaaatatcgggagcaggaaaatgctggttttctcagcattaatctgagatgcaggtttcagatgttttaaggggaattattaacaaaaggatgctcccayaaggacagcgagatttgcaggcatccagatggttggcccttccctcaggctctctgctagggatttctcatgggtttcttcattaatttccttagagaca

SEQ ID NO: 117890 - DNA, 201 bp, Bos taurus; identical to SEQ ID NO: 76606

SEQ ID NO: 117891 - DNA, 201 bp, Bos taurus
ttcatataggtcaaagaaacctgggccacttgagtgttagaacatatcattaatctactctagtgatgacaacatgttaatcagaccaaatgactaaaagygtcaattatatcagagtactgataaaatatgcggactccggaggacaagaggtaaaccttgggagattcaaggcctagtggcccagtggtctagaacacg

SEQ ID NO: 117892 - DNA, 201 bp, Bos taurus
ctcacaagaccagtttctcagggttgtatgaattcctgtgcctcagaatagttcatttggagaggccatttaatctcttaaatctcttaaaagtcaaatcrttgcctccgtgggcactaacgttccccatcttttggtttgggaatgcatggggcatgtatagagacgaaatgggtcctgtgtcatctcctggctctgcaa

SEQ ID NO: 117893 - DNA, 201 bp, Bos taurus; identical to SEQ ID NO: 76608

SEQ ID NO: 117894 - DNA, 201 bp, Bos taurus
cccagtgcaccaggcatttgggggctagaagcccagcgttctcctgcctgtgaccctcagcagaggcagggcaggaagcagatgacccgggcctggcagcrtctgagactctttcctgagcattcttgtaaaaaagcaaccacattgccacatgtgcctggaatttgatttccaggccaagtgtcagcttttccatgctaa

SEQ ID NO: 117895 - DNA, 201 bp, Bos taurus
tcaaagagaatcaaaactaagttatactgtttagactggacagtaaaaagcaaagaaaacattaaaaaaaaaactcaggatgatggttaattcaagaagtrgctcatgattacacagatgtctattctattatgagttgttaaactgtatttgtatattcatgcacttttcagcatataatttatattttttatgtaataa

SEQ ID NO: 117896 - DNA, 201 bp, Bos taurus; identical to SEQ ID NO: 76609

SEQ ID NO: 117897 - DNA, 201 bp, Bos taurus
tctcccctttctccttttctggggctggcatatgatgcgatggggagccaccttgggatacaacaccctgaggacagcagagcagcaaggtcaaagacacytgacccctcgaatgactctgcagagcaaggccaacaagccagccagactttcagagagagaaacaaactgctatactctttatgcccctgttacctgggg

SEQ ID NO: 117898 - DNA, 201 bp, Bos taurus; identical to SEQ ID NO: 76611

SEQ ID NO: 117899 - DNA, 201 bp, Bos taurus; identical to SEQ ID NO: 76612

SEQ ID NO: 117900 - DNA, 201 bp, Bos taurus; identical to SEQ ID NO: 76613

SEQ ID NO: 117901 - DNA, 201 bp, Bos taurus
cattggtggcaagtttctcatttggtaaaaaggtgtctattatacatttcaatcagaaacaataagaggagagatttcctgggggccttaagacactgtakgggtctattccactgcagggggtgcagtttgacctgtggtcaggtaactagggggcttcccaggtggcgctggtggtgaagaacccacctgccaaggccg

SEQ ID NO: 117902 - DNA, 201 bp, Bos taurus
gggaagtaatgaacaagaccttacaaacatcctgtaaattcatgagctagagaaaaggatgcaaactctttaagtattagcagtggccttgaaagtaacaraaatgagagaagaggaccaggtgaagaagagagaactggggaagcgttggcagttgacactttggccttggcacaagggagaaagccaggagacttagtt

SEQ ID NO: 117903 - DNA, 201 bp, Bos taurus; identical to SEQ ID NO: 76617

SEQ ID NO: 117904 - DNA, 201 bp, Bos taurus; identical to SEQ ID NO: 76618

SEQ ID NO: 117905 - DNA, 201 bp, Bos taurus; identical to SEQ ID NO: 76621

SEQ ID NO: 117906 - DNA, 201 bp, Bos taurus; identical to SEQ ID NO: 76622

SEQ ID NO: 117907 - DNA, 201 bp, Bos taurus
tgcaagaggcacaaatgcctccgagaccataactggtttaaatggtcatgttggtactggagaaagagaggaaagaaggctgaaccagtaggctggagttrgagtctgaaggactttttactctagagtaggcattgggaaaaggagtacgtcaaagctgcatattgtcaccctgcttatttaacttctatgcagagtaca

SEQ ID NO: 117908 - DNA, 201 bp, Bos taurus; identical to SEQ ID NO: 76627

SEQ ID NO: 117909 - DNA, 201 bp, Bos taurus
gaatttctctaaaagaagccatgttttaaaagaaacacaaaatatgttcacatattctcacggaaaagatggaaataatagagactaagtagtttctccartttattttttttcaataatttctctgtaaaacgtaagtggaaacctataaattttgttcattttaacatgtgtaaaaattaaagcagcaagcaataagaa

SEQ ID NO: 117910 - DNA, 201 bp, Bos taurus
gttgttggttcagtatagttttgatgggctcaaggtttagccccagggattttgatgaagtcactccatggccagtgtttgagagccaccagctaagagtyggacatgactgagcaacttcactttcacttttcactttcctgcattggagaaggaaatggcaacccactccagtcttcttgcctggagaatcccagagac

SEQ ID NO: 117911 - DNA, 201 bp, Bos taurus; identical to SEQ ID NO: 76629

SEQ ID NO: 117912 - DNA, 201 bp, Bos taurus
attgataaatacaattttagaattgataaatacataaagatagaaagcaggttagaagctgtgaaggttaattataagtgtaaacttgactgggccaaagrttgcccagatacttgttagcagttatccctgaaagtgtctgtgagcatttaaatcattacatttaaatgagtgcattgatctcatcaatgctagtgggta

SEQ ID NO: 117913 - DNA, 201 bp, Bos taurus; identical to SEQ ID NO: 76630

SEQ ID NO: 117914 - DNA, 201 bp, Bos taurus
agatttgaggaattactctacaagaacagggcaggttctatttttgacatttcagcaatgagaccacttgtatattacggcctgatttgatttactgtacraaaataagagttctgtaatttgtaaaagacatttattacatgagtccaaaaattaggaaaaaaaaaaaacatgcttagtgtctctgtctatcccatctgg

SEQ ID NO: 117915 - DNA, 201 bp, Bos taurus
ttcatatatcaagttcgtagtggccatctgttccctccgaactgctgcgtctccctccatctgccctgtttttcttctgctaatcgggtggcaagggctcwgatgatcgggaagtttctctctgacttttgatttgtcagtcatcatcaagccagctgtgcatttgtaacagactcctccgacgggtggtggtgaatttaa

SEQ ID NO: 117916 - DNA, 201 bp, Bos taurus; identical to SEQ ID NO: 36907

SEQ ID NO: 117917 - DNA, 201 bp, Bos taurus; identical to SEQ ID NO: 36908

SEQ ID NO: 117918 - DNA, 201 bp, Bos taurus
agaaggtaaaaagtgggtttgaataatgaaatacaactagcctgccaagaagtcatctctactatcagaaacctacacatgaggcccttatttttatttcytctttctaaatacatgttggtctctcatgcccatcttactgatgtgtgggcaataagagtaggccagtcagaagacgttaaatgcactattttgattgca

SEQ ID NO: 117919 - DNA, 201 bp, Bos taurus; identical to SEQ ID NO: 36910

SEQ ID NO: 117920 - DNA, 201 bp, Bos taurus; identical to SEQ ID NO: 36911

SEQ ID NO: 117921 - DNA, 201 bp, Bos taurus
agtttattggtttttaattttggctatatttgttaattcactaattctatctcttttctttagggtagatgacccttaaaagctgaatttggcctttttgytttatggctatatctctaacatatccaacatataataaaatattgaataaaatatttgataaagaatgagtgagtggattttctttgtttcattttacta

SEQ ID NO: 117922 - DNA, 201 bp, Bos taurus
tcaacaaatggcatgcagcctcatacagcaagagagccaattcaaacagagacaatgtttcagtaaaaacctagcataagcaatcccttggtttcacaggrgaaggcagtatgtgctgtgattcagaatagtatgatgatggtagcctccaatacacctcaccttaaatcccagcacactgaatctcaatctctttatcta

SEQ ID NO: 117923 - DNA, 201 bp, Bos taurus; identical to SEQ ID NO: 36913

SEQ ID NO: 117924 - DNA, 201 bp, Bos taurus; identical to SEQ ID NO: 36919

SEQ ID NO: 117925 - DNA, 201 bp, Bos taurus; identical to SEQ ID NO: 36920

SEQ ID NO: 117926 - DNA, 201 bp, Bos taurus; identical to SEQ ID NO: 36922

SEQ ID NO: 117927 - DNA, 201 bp, Bos taurus; identical to SEQ ID NO: 36923

SEQ ID NO: 117928 - DNA, 201 bp, Bos taurus
tttttggccttctacttcctttcttcatgtgcccccatgagatatttgccaagtctctgagtcctatttctacagtattatcgttacgcattctgcgaacyggctttctaagagtcttaggaagaaaaacattgagtaaaagcatttgcttacaaaatacagtattttaagcggttgaccttgatttgttccaaatctttc

SEQ ID NO: 117929 - DNA, 201 bp, Bos taurus; identical to SEQ ID NO: 36925

SEQ ID NO: 117930 - DNA, 201 bp, Bos taurus
gaaggcttcctctgagggctgggaggaagaatttattccttgtctctcccctagcttctggcagttgctggcaatccttgctggccctgggcttgttgackcatcagctgatcctgccttcactgtacctggcattctccctgttcatgtgtgtctgtctctacatttctccttttccaaggacactattagagtagtggc

SEQ ID NO: 117931 - DNA, 201 bp, Bos taurus
ttagctattttgattacccaatatgcagatttttgtaaaatttccaaatatgactatgcaagtctgaatgtgtatctgatgcttttctaagtgctttaatytgggtcaggatacttctagaaagtaattattgttataccaagttttaccattaaaacattggaatctaggggtgggtaatttcttacaaccacaattcac

SEQ ID NO: 117932 - DNA, 201 bp, Bos taurus; identical to SEQ ID NO: 36931

SEQ ID NO: 117933 - DNA, 201 bp, Bos taurus
ttttatgaatattgcatattagacttcaaatttgagaacaatgacaatattgaactcatttttattttctccatactcagcagtcagtacacacacaacayggatgcttaattaaggtttgttgaattaacagtattaaaataaccagtgaaagaataaattatgtgcttctattaacttattctctaggtaaaatagcta

SEQ ID NO: 117934 - DNA, 201 bp, Bos taurus
atttctgatagttgtaacagcctattttaagctgataatgacaacttcaattgcataaggaactgttttacttctgctctattttattcaagattgacaayttatgtctttttaaattgtatacccattaccaagttattgtaactatagcttttttttagtacttttgtcttttaaagtttatacttgtactaaaagtaa

SEQ ID NO: 117935 - DNA, 201 bp, Bos taurus; identical to SEQ ID NO: 36936

SEQ ID NO: 117936 - DNA, 201 bp, Bos taurus; identical to SEQ ID NO: 36937

SEQ ID NO: 117937 - DNA, 201 bp, Bos taurus; identical to SEQ ID NO: 36938

SEQ ID NO: 117938 - DNA, 201 bp, Bos taurus; identical to SEQ ID NO: 36940

SEQ ID NO: 117939 - DNA, 201 bp, Bos taurus; identical to SEQ ID NO: 36941

SEQ ID NO: 117940 - DNA, 201 bp, Bos taurus; identical to SEQ ID NO: 36942

SEQ ID NO: 117941 - DNA, 201 bp, Bos taurus
cgattcatctgcgaacgatcaggcccctccggcctccctgatttcacccctgacaaccccgctttgttcttcatgctccaaccacaccggccattctgttyctcaaatgtgtgataatcggtgatactgttccccgccccgagtgctcacgcacgattctctgcagctccctctccgcgttgcctggctcactcctgctcc

SEQ ID NO: 117942 - DNA, 201 bp, Bos taurus
caaccagagatggaggctgggtcacaacagcaaaagcaccagatcccagcgactagactggcagttagtgacaagggccctggccctttggcgctgcagaraagaacttccacaaagacaggagtggtgaagcaagtacagtatttattaggaggaaaagtacagtacgtatggatagacacatgggcagactcagagaca

SEQ ID NO: 117943 - DNA, 201 bp, Bos taurus
tgaagtgtcgtgaggatgaaatgaggatggcctaagagaagctgaaaaattcacttcgaatgaggatgttaagcttaaatctaagctctgacacgggcagragagttggccattggaaaagatggaagatgagctctgaggagatgaaggtcctactagctcagtagggtgttaccagtgatgccaaggaatgcatctgcc

SEQ ID NO: 117944 - DNA, 201 bp, Bos taurus; identical to SEQ ID NO: 36943

SEQ ID NO: 117945 - DNA, 201 bp, Bos taurus; identical to SEQ ID NO: 36944

SEQ ID NO: 117946 - DNA, 201 bp, Bos taurus
gaatagactgaggactgaggatttataggggagcagtaatattctctatgatactaaaatgatagcttaccgtcatagcttattattccacacccatagartacacaccaccaagagtgagccagctatggatctgggtaatttcaatgcaaaaatgcaggttcaccaatggtaacaagttgtttgggggctagggaatat

SEQ ID NO: 117947 - DNA, 201 bp, Bos taurus
tacctacagggggactggccatcactccagcaccatcctcactcacctgcagtcacattcacaagggccctccctgggccctggcctcacccactaacacrgagatgccagttccagaatgcccactgtccttcatccagacactctgggaccaggttctgtacgccacagcgctggcactagtccgaggacccttgggcc

SEQ ID NO: 117948 - DNA, 201 bp, Bos taurus
gggagagaaagcctttaaggcaacaagacattatccaagggaggggtttaggcttatcccctcccctgcacacacggcacacacttaggcgagagggccarctccaagggatctaaaaaactgagtgggtcactttcaaccctggagaccagtgtctcaattctgaccacaggcttgctgagcagagatgtgccggccagt

SEQ ID NO: 117949 - DNA, 201 bp, Bos taurus
aggatgtgacgaatgatgtgactgaaaaatgaacagggccaaagggaatgacggtgcaaatgctgggttggtcagaaagcttgttcgagtaagatgttatrgaaaaagcttgaagaactctttggccaaccgcataacacggccaaatgtccagtgacttggaggaagaagggcagtgaaaggaaacgtgtacagctggag

SEQ ID NO: 117950 - DNA, 201 bp, Bos taurus
atctcattgcaatattttctttagccacattttattacagaacaggaataattctctgaagcctactttggcaaatatttccatctgtttgttgtttaatmttttatttaccctttaaaacaaaactacagtgtgtttgataaaatgataacctattgtaattgatttttaatatgctgtcctgtaatctctttaatttct

SEQ ID NO: 117951 - DNA, 201 bp, Bos taurus; identical to SEQ ID NO: 36948

SEQ ID NO: 117952 - DNA, 201 bp, Bos taurus; identical to SEQ ID NO: 36950

SEQ ID NO: 117953 - DNA, 201 bp, Bos taurus
cttgctttcgatagaagatgtgtttacaatcaatagaatatggcagaagcagtgggatgccagttttttgattaggttactgcatatggcagagtctcackatcttaattgttacgttatataagactttgttctagctgaccaaagggacagaagttcttctgctaaccctgaagcaaatgagattcaaagcggattctt

SEQ ID NO: 117954 - DNA, 201 bp, Bos taurus; identical to SEQ ID NO: 36951

SEQ ID NO: 117955 - DNA, 201 bp, Bos taurus
tccacaatagtgtaggagggctcccttctctctctataccctccccagcatttactgtttgtgaatgtttcgatgacagccattccggctggtgtgaaggsatatatcattgtagttttgatttgcatttctctcataattagtggtgttgaatatcttttcatgtgccttttggccatctgtacgtcttctttggagaaa

SEQ ID NO: 117956 - DNA, 201 bp, Bos taurus; identical to SEQ ID NO: 36955

SEQ ID NO: 117957 - DNA, 201 bp, Bos taurus
gccagttttgtgagagagggattccagaggggaaatgatgcatttgtgtgtggaagcctttgctctgagtcttatggtggagctactgttgatcggcaggracagaagtaacgagaaaaccagacatggagtattgcagaataaggcttccctggtggctcagatggtaaagcatctgcctacaatgtgagagacccgggt

SEQ ID NO: 117958 - DNA, 201 bp, Bos taurus; identical to SEQ ID NO: 36958

SEQ ID NO: 117959 - DNA, 201 bp, Bos taurus
gggcttaaacaggataaatttacttcttctaagttctagaggtttgaagttctggatcaaggcatcaacagggttggctttgggttggtctaattctaccrgcctctatccttagcttatagatggccaactttatactctgtcttcccattgtctttcctccaaacatctgtgtactaacaccctgtctttaaaaggaca

SEQ ID NO: 117960 - DNA, 201 bp, Bos taurus
ggaggtacttaaaccagagggtggagttctggtctctcagattccagagagattcctagtcgctttcatcatgtgaagacagaaagaaggcatcagaaacraaccaggcaaatggccctagtctaacgacactggcaacacgagcaggaattccagtctccaaaactgtgagaaatgaatgtctattgtttgttagatacc

SEQ ID NO: 117961 - DNA, 201 bp, Bos taurus
tttctctccatcatacatagctatgtgcctcttttcatacatgttgatgaagatattttactaagtatatcatttttctaaggtcaagttcacttgtcttkctggccagtcaacttccataagttctacactagcaggacttcccctcaactgcacaaaatatttctcttcttggttcactctctagactttatatacaag

SEQ ID NO: 117962 - DNA, 201 bp, Bos taurus; identical to SEQ ID NO: 36959

SEQ ID NO: 117963 - DNA, 201 bp, Bos taurus; identical to SEQ ID NO: 36960

SEQ ID NO: 117964 - DNA, 201 bp, Bos taurus; identical to SEQ ID NO: 36963

SEQ ID NO: 117965 - DNA, 201 bp, Bos taurus; identical to SEQ ID NO: 36964

SEQ ID NO: 117966 - DNA, 201 bp, Bos taurus; identical to SEQ ID NO: 36965

SEQ ID NO: 117967 - DNA, 201 bp, Bos taurus; identical to SEQ ID NO: 36966

SEQ ID NO: 117968 - DNA, 201 bp, Bos taurus; identical to SEQ ID NO: 36967

SEQ ID NO: 117969 - DNA, 201 bp, Bos taurus; identical to SEQ ID NO: 36968

SEQ ID NO: 117970 - DNA, 201 bp, Bos taurus
agtgcgtcgtcgtggagaagccctcctccagccccaggcgcgagagccgagatcaaagcgcaaagcacaaatgctgctctgatcaaaacacagctttcggygtttgatgtggcccagcctctattgaggtaaggacaatggagtagtgtggccaggggactttggcaataagtataaagcaaggtgcactccatcaaataa

SEQ ID NO: 117971 - DNA, 201 bp, Bos taurus; identical to SEQ ID NO: 36969

SEQ ID NO: 117972 - DNA, 201 bp, Bos taurus
catacacccccagggagagaggcctctcctggttcacagaggttctttctgctcccatgctgcgtgcttgcagaccacagcagctgcagtgagcccggctycttcttggcctcgtagggttagtggctggggccgtgtggcagcacagtgggatgcttcagtggtgaattagccaaggaggccagatggctttactctgca

SEQ ID NO: 117973 - DNA, 201 bp, Bos taurus; identical to SEQ ID NO: 36970

SEQ ID NO: 117974 - DNA, 201 bp, Bos taurus; identical to SEQ ID NO: 76698

SEQ ID NO: 117975 - DNA, 201 bp, Bos taurus; identical to SEQ ID NO: 76699

SEQ ID NO: 117976 - DNA, 201 bp, Bos taurus; identical to SEQ ID NO: 76700

SEQ ID NO: 117977 - DNA, 201 bp, Bos taurus; identical to SEQ ID NO: 76701

SEQ ID NO: 117978 - DNA, 201 bp, Bos taurus; identical to SEQ ID NO: 76702

SEQ ID NO: 117979 - DNA, 201 bp, Bos taurus; identical to SEQ ID NO: 76703

SEQ ID NO: 117980 - DNA, 201 bp, Bos taurus
cacatttatgatgaaaactattcagaaaatgggcccagaaggaatctcagttcagttcagtctctcagtcgtatccgactctgtgaccccatggactgcarcatgtcagatcactctggccatccccaacttccggagtatacccaaactcaggtccattgagttggtgatgccatccaactgtctcatcctctttagttc

SEQ ID NO: 117981 - DNA, 201 bp, Bos taurus
cttccactatcccacttgcctttacggttattggtttagtcattcagttctgtactttgccaccttattttttggactttctgcctttcagttggtatatrctgtttaactctgtttgaccctggactctactgtgtccatgtctgtatttatttgctgttgattcagggctggtctcttgggcccctgacttatgccttt

SEQ ID NO: 117982 - DNA, 201 bp, Bos taurus
gggacagaaagggagattcagaggctcaaagaaaaatgtgaaatacactcgttgcaggcagaacaaagagaaactagaacagatggtcctagtcaccctgytgcactccacaacctgagatgcacatgtgttggagcatacaggagctggttgctgaaactcagcctttggctgacagacttaaggaaaggcatagagaca

SEQ ID NO: 117983 - DNA, 201 bp, Bos taurus; identical to SEQ ID NO: 76705

SEQ ID NO: 117984 - DNA, 201 bp, Bos taurus
tccagcatttctaaatataactaatttctccaaactaatttttccccttttgtgaaggagaagcaaataaaatataatgcaaatctatcaagttatgtackttaaaaagggtcttatctaattggtgaattccttcattttctggtgcatttatttgttgcacatgatatataagcatcacatgcagcaaaaaatcacatg

SEQ ID NO: 117985 - DNA, 201 bp, Bos taurus
ttagacaaaaagtctatgttgcttgaaacgtcacattttcttacatataaaggagtgttccagctgcatacctaggtataattttacaaaatccattaaamaaatttggagtcaaaatattcccaaatccagggacaattaaatcttttttttaagatagcaattgcttgaaattaacatactatcataattttataaatc

SEQ ID NO: 117986 - DNA, 201 bp, Bos taurus
accccgactagcattcaaagttataaaaattatatgagtaataaaattaaggcttttatagatgtagggtaataaaaacataaatacagaggacaataagkaaaaagatctcaaggaaacactatgaagtgtttgcgaaacacacacaaaaattatacatgttgctaagcaagtatgaaataaactcaaagtttaggcagg

SEQ ID NO: 117987 - DNA, 201 bp, Bos taurus
gatttattcaaatggaggttcaggtatccaagatggagaagtgcacaatgcttctgaagacctgggctcagaatcgtacagtgtccctctgctacatcatkctggccaaaaccaagttacaaggccagtctggagtcagagcaaaagacatggatacaaagaagccaatgattgcagctatcaataaaattggtattgtat

SEQ ID NO: 117988 - DNA, 201 bp, Bos taurus
tgttacctgtgtccttcagggaataattaaagattctgtgactatataagactgacttgctatttaaattgttatctgttctcctggcccaactgctattrttttcttattgcatgttcacattatttcaatacttagctctttaggaggcttttgtgactcagaggaggcctggcagaccaagcatttcttcaaataaga

SEQ ID NO: 117989 - DNA, 201 bp, Bos taurus; identical to SEQ ID NO: 76707

SEQ ID NO: 117990 - DNA, 201 bp, Bos taurus; identical to SEQ ID NO: 76708

SEQ ID NO: 117991 - DNA, 201 bp, Bos taurus
gcagggactttatggtccacacacaacaagcagcctatgagaagcccaggtgtataagacacggggctacaaaggaaaggcggccagtgtgactggagtgytgagagcatgaaagagaagcgatgtcactggagacaaaggtcgggtccggatgctgcagggccttgggccacattaacaaattttgatttcaagtgcaaa

SEQ ID NO: 117992 - DNA, 201 bp, Bos taurus
agtatcctggcctcccagaactctttatcactctatattcttgctttaaaaggggtgtctggagagcccttgccagcgcttgcagaatgaataaaggtaayccaaggaggccggtggttgaatttggtctctgtcaccaggaggaaaccaggttctgcagctggaaagaattaaaatgtaatagttggcagtgctttattg

SEQ ID NO: 117993 - DNA, 201 bp, Bos taurus
agacttggttcatgatggtcatctgggcccccgagtcgacgaaagccttcagaggatgcccgttgactctgcagttgatgtagagcatagccacctggccraagctctccggcgcctcttccatggctatgctcatgttctcctcgatgttctgctgccggatctcctcctctatcttggcttgggcctccagatcgaacg

SEQ ID NO: 117994 - DNA, 201 bp, Bos taurus
gtgagtgtgaaatgaaatccatattagggtaaaattccaaggtgaagaaaagatttaaaacattgcatcaaagttctcatttgggccctatccaaaatacrtgacttctttttcagaaagcctttatgtccgtcctaatgtacaacataaattgaagcacagtctctgtggaggcctggtaacctggcaagactcacagaa

SEQ ID NO: 117995 - DNA, 201 bp, Bos taurus; identical to SEQ ID NO: 76711

SEQ ID NO: 117996 - DNA, 201 bp, Bos taurus
accaggagtcagtcaaatcgttcatttaataggcaatgagtgcttttagggatgcttcataatcttacaaattttcaggtgaaattttctgtaccataacracacctagatatttatgctgttctagtttagtggctctaatggtgggagtttcagtgatgtcaggctggtaagaaggaggtgtagcagtagcggaaagta

SEQ ID NO: 117997 - DNA, 201 bp, Bos taurus; identical to SEQ ID NO: 76712

SEQ ID NO: 117998 - DNA, 201 bp, Bos taurus
atgtggtctttaattctgtactttttaaccccaccttttcaaaatttgcatttaaacaagtgcggaggtctgtcgtttgacctctgccctctgaccttttycctctcccttagtttaatggtcgctgccttaagacttttgaaaagtatagtctttgttggagaagttgccaatctttgcatacagccttgcctctccttc

SEQ ID NO: 117999 - DNA, 201 bp, Bos taurus
tcttgcattggcagatgggttctttatcagtagggataccttggaaattctattctttgcagcaccaactactgtcaaatgagaatgcagacccagtgttktaatttctgaaaaatttcccctagaaaacctgaaatatcagatttttaatgtaaatcttgtataaatcttgaatcataaatattcacaactaaacccatc

SEQ ID NO: 118000 - DNA, 201 bp, Bos taurus
ctaaatggaaacagtgaccaccaggaggaaaaccaccatgagccagattctaaccatgaaaaggctttcagccacttaacatgtgaatttagaaaatcackcaacctctgaaaaatagaaatggtcaagaaaaatcccaataatatctaaaagtaaatgagagatcagtggaaatcaatattccattcagtcactacttta

SEQ ID NO: 118001 - DNA, 201 bp, Bos taurus; identical to SEQ ID NO: 76714

SEQ ID NO: 118002 - DNA, 201 bp, Bos taurus
ctgcagaccggtgagctcccaagacctggggaaattgggctaagggtgcaggggggggacggagatgaagttagggaagcggcagggacgacaggtggtgracggtcttgtgggcctttgtacaggctttagagtccagaggtttaagaggagaaacatcacttgacttgcgtttaaaagaatcacaggctactctgagga

SEQ ID NO: 118003 - DNA, 201 bp, Bos taurus
gaagagccacatgtgactccctcactccctcagccagcctgggtttgctcctgccacacacaaggcctttgcacttgctggcccaccctcctggaccctcyctctgctgcatttggacagcatgctccgttatccctttacttactagctcgcaggccccttaccgtaagtcccaggactgctggggctgtgtcctgttcc

SEQ ID NO: 118004 - DNA, 201 bp, Bos taurus; identical to SEQ ID NO: 76716

SEQ ID NO: 118005 - DNA, 201 bp, Bos taurus; identical to SEQ ID NO: 76718

SEQ ID NO: 118006 - DNA, 201 bp, Bos taurus; identical to SEQ ID NO: 76720

SEQ ID NO: 118007 - DNA, 201 bp, Bos taurus; identical to SEQ ID NO: 76721

SEQ ID NO: 118008 - DNA, 201 bp, Bos taurus; identical to SEQ ID NO: 76722

SEQ ID NO: 118009 - DNA, 201 bp, Bos taurus; identical to SEQ ID NO: 76723

SEQ ID NO: 118010 - DNA, 201 bp, Bos taurus
ggcaggcagaatgagcgatttcccctctctgaccatagcttcctgacacagttcccacttcccagttcttagtgcttcaagtacccaacccttcataattyactcaggggctaagttttagggcccatggttaatttttcctaatgagcactctattgtcatgtactttatgatacccagaaaggtctctattgtttttaa

SEQ ID NO: 118011 - DNA, 201 bp, Bos taurus
aaactctgcttagttcttctcattcttctaaaattcaatctaatcttctcattgatcatttatcctttgtcactgtttaaggttgccaaactgccagcttytacctgataatttacaatacacatctatttgacctaaaataagtctgacttaaaaacattcaataaattgaggcgagagctaattctaatattggcttat

SEQ ID NO: 118012 - DNA, 201 bp, Bos taurus; identical to SEQ ID NO: 76725

SEQ ID NO: 118013 - DNA, 201 bp, Bos taurus; identical to SEQ ID NO: 76726

SEQ ID NO: 118014 - DNA, 201 bp, Bos taurus
ctacacacatgtgaaataagctctgttaatctgaactccctccttatgaaaaacaaaacaaaacaaaacacattaaacccttggcactgggcctggttcaraatgttattttttaaatctgtggtgaatgctgaaaatgagagttctctagtaaacattgggtaacatggaggccccctttccaggggcagcaggccctat

SEQ ID NO: 118015 - DNA, 201 bp, Bos taurus; identical to SEQ ID NO: 76730

SEQ ID NO: 118016 - DNA, 201 bp, Bos taurus; identical to SEQ ID NO: 36971

SEQ ID NO: 118017 - DNA, 201 bp, Bos taurus; identical to SEQ ID NO: 36972

SEQ ID NO: 118018 - DNA, 201 bp, Bos taurus; identical to SEQ ID NO: 36973

SEQ ID NO: 118019 - DNA, 201 bp, Bos taurus; identical to SEQ ID NO: 36974

SEQ ID NO: 118020 - DNA, 201 bp, Bos taurus; identical to SEQ ID NO: 76734

SEQ ID NO: 118021 - DNA, 201 bp, Bos taurus; identical to SEQ ID NO: 36976

SEQ ID NO: 118022 - DNA, 201 bp, Bos taurus; identical to SEQ ID NO: 76736

SEQ ID NO: 118023 - DNA, 201 bp, Bos taurus; identical to SEQ ID NO: 36977

SEQ ID NO: 118024 - DNA, 201 bp, Bos taurus; identical to SEQ ID NO: 36978

SEQ ID NO: 118025 - DNA, 201 bp, Bos taurus; identical to SEQ ID NO: 36980

SEQ ID NO: 118026 - DNA, 201 bp, Bos taurus; identical to SEQ ID NO: 36981

SEQ ID NO: 118027 - DNA, 201 bp, Bos taurus; identical to SEQ ID NO: 36982

SEQ ID NO: 118028 - DNA, 201 bp, Bos taurus; identical to SEQ ID NO: 36983

SEQ ID NO: 118029 - DNA, 201 bp, Bos taurus; identical to SEQ ID NO: 36984

SEQ ID NO: 118030 - DNA, 201 bp, Bos taurus; identical to SEQ ID NO: 36985

SEQ ID NO: 118031 - DNA, 201 bp, Bos taurus
agccagctttcaaaaaccaaaatgaaaggtcaaacaatccaataaaaatgggcatgacagtcgagaatgcatttttccaaagagaatatcaaataaaccartaagtatatgcaatgattctgtctctttagttttagaaaaattaaagagtaagacaacgccaccaccaaaagcacaatgtgacatcacaacatatagcac

SEQ ID NO: 118032 - DNA, 201 bp, Bos taurus; identical to SEQ ID NO: 76745

SEQ ID NO: 118033 - DNA, 201 bp, Bos taurus; identical to SEQ ID NO: 36986

SEQ ID NO: 118034 - DNA, 201 bp, Bos taurus; identical to SEQ ID NO: 76746

SEQ ID NO: 118035 - DNA, 201 bp, Bos taurus; identical to SEQ ID NO: 36987

SEQ ID NO: 118036 - DNA, 201 bp, Bos taurus; identical to SEQ ID NO: 76748

SEQ ID NO: 118037 - DNA, 201 bp, Bos taurus; identical to SEQ ID NO: 37006

SEQ ID NO: 118038 - DNA, 201 bp, Bos taurus; identical to SEQ ID NO: 37010

SEQ ID NO: 118039 - DNA, 201 bp, Bos taurus; identical to SEQ ID NO: 37011

SEQ ID NO: 118040 - DNA, 201 bp, Bos taurus
acagtgaggcagcgcaccagccccctgggccaggagcatggctcgacttcattattggatcacacaaccaactttggggcccttttctcatcacaggtccygtgggcagcagagcccaccagccacccagcattcctgggctgggttcccacccaaaccctgaagtcagccagggccaatatttggacccaattatgtatt

SEQ ID NO: 118041 - DNA, 201 bp, Bos taurus
tggaggaccagtggttaagactcagtgcttctaatgaaggggacaaaggtttgatctctggccagagaactaagatcccacatgtgtcatggtttggccaytaaaaaaaaagagtgccatacataaggaaattgcactcagtagaatgttattgaggtcctacataatgtatatattatgtatgggaggggttttgttggc

SEQ ID NO: 118042 - DNA, 201 bp, Bos taurus
gaggagtgtggttaattatgatggctacacataagaagagtcctgggacctctcttaggtcaagagtcacattgatagtttataaattcttcaaggtaagrtggagaattgaaattaaaatcagcaagagaacttaggtcatggtgtttggggaggggaacataaatcatgctgaagtggtgaggtgagtgaataagagtg

SEQ ID NO: 118043 - DNA, 201 bp, Bos taurus; identical to SEQ ID NO: 37014

SEQ ID NO: 118044 - DNA, 201 bp, Bos taurus
ctggattgttttcatattttggctattattaataatgttacaatgaacatttgaatacaagagtttgttgcatatatttctattctcttaggccaattcckaggagaggaattgctatgtggtaagttaagtatatggcttagtttttaaagaaattgccacactgtttacccaagaggccatgccatttcacatttcacg

SEQ ID NO: 118045 - DNA, 201 bp, Bos taurus; identical to SEQ ID NO: 37022

SEQ ID NO: 118046 - DNA, 201 bp, Bos taurus
gtagtttattgctaatctcgtagcactctgattacaaaagatgctggatatgacttcagttttcttaaatttttaaggctgaccttgtggcctagcacgtrgttaatcctggaatatgtcccattgctcacgagagtaacgtatattcagctgcttttgaatggaatgctctataaatatcagttaagtccatctgctcta

SEQ ID NO: 118047 - DNA, 201 bp, Bos taurus
gctgcagtatccagcatgttgaactagcaaaattagtaacaagggaagaaaattttaaagataagcaaactaaaaggtattgcttttaactgttagaactyggtccccaaataggccttagaatgttctttaaccttccaaaagtttttctaaaaggttttctccacctgctacattaaaatttaatacagatgataaagt

SEQ ID NO: 118048 - DNA, 201 bp, Bos taurus
cggatgatttttcagttagatttggatgtgtataagaggtttctagaggaagaagtagggagaagggaatccaagaagtaactgtaggcccaagtgtagargcacaaacatgcaatagtaggttctggaagcaagtggtctatgcctagggcacaagtgcaaagagctgtgggcaagaagcctggaaaagtaactggaggc

SEQ ID NO: 118049 - DNA, 201 bp, Bos taurus; identical to SEQ ID NO: 37027

SEQ ID NO: 118050 - DNA, 201 bp, Bos taurus
aatcagagttggccagtttgtcttactaattccagatatactggaaataggattggatttgtaaaggggctgaaaccttggaattgatgatatgatgtaaytaatgttacattacagggaaaggctaagatctttacattagatttctgttgtgccacattccagaatatttttgctattaggaagggtttccaaatctct

SEQ ID NO: 118051 - DNA, 201 bp, Bos taurus
tgtatttgggcctagtcatttgctagatcagattggagttaggtgatttaatatggtctcacacactatctgggtcttcagcttggattgttggaacatcygtggtggcctggcttctctctccacatacactttcagttagagtttctctgcagtgtgtgggtttcaaagtatgagagatatagacagagagagagaaat

SEQ ID NO: 118052 - DNA, 201 bp, Bos taurus; identical to SEQ ID NO: 37028

SEQ ID NO: 118053 - DNA, 201 bp, Bos taurus
ttccccttggaaagtaaacccaggtctcttcggataagatccctgcagttttgctgagcactgtggcagggattctcctccgggaggagggcccacaggarcctgaacccttctactaccctcccctttctcctctcttggggcagctaattattctagggagctgagagaagtgaccctgactctctgtgacctctcgga

SEQ ID NO: 118054 - DNA, 201 bp, Bos taurus
tttgtctgttcaagcaccaatgccataatgattctattactataactttacaataacttctggcattttcatacagtgtgttttcctcgtcctttctcagractgttttggacttttgtttcttgtatgttttagatttggattattagcatccactggagatggtgactgcagccatgaaattaaaagacgcttgctcct

SEQ ID NO: 118055 - DNA, 201 bp, Bos taurus; identical to SEQ ID NO: 37030

SEQ ID NO: 118056 - DNA, 201 bp, Bos taurus; identical to SEQ ID NO: 37032

SEQ ID NO: 118057 - DNA, 201 bp, Bos taurus; identical to SEQ ID NO: 37033

SEQ ID NO: 118058 - DNA, 201 bp, Bos taurus
tacaagatggtttgtgtgtatctcttatgacctagtggttcttatacataaagttcaattttttttatatggtataaaatgccctttaagatctggctcartgtcttcttatcaacctcatttttcacttcccatttttttcagttctgcacacagtcccacccatcgtttcatatgcctcaattacttccttctacacat

SEQ ID NO: 118059 - DNA, 201 bp, Bos taurus; identical to SEQ ID NO: 37039

SEQ ID NO: 118060 - DNA, 201 bp, Bos taurus
actgcagcatctgcagtgattttggagccccaaacaggttaggttgtttatttgagattttacttgtttcctgaggaaggcctgtactgatgtcaactccmcatacaaccctgtgtgttagttactcagttgtgtgtgactctttgcaaccccacggactgtggcccgacaggcttctctgtccatgggattctccaggca

SEQ ID NO: 118061 - DNA, 201 bp, Bos taurus
tccacctttggattcctgagctccatggaagaagtacaacggccctgagcttgccatgttgtgaggaagtccagaacacatggaaaagctttttgtaggtrctctggctgacagtctcagacgaggttccagccaatggacgtgtgacatcatcacagacaccaaccaccgaccatataagagtggagatgcttccagatg

SEQ ID NO: 118062 - DNA, 201 bp, Bos taurus; identical to SEQ ID NO: 37043

SEQ ID NO: 118063 - DNA, 201 bp, Bos taurus
atatagattgtgctacttattaatacagaatgttatgtaaagattaatgattatctgttttcaataaatgaagtacttgaccaacccatttagtgaacctrtttgaagcagcaccctctggtgggatttggggtcagaagaatcagggctccaagcctgttttcatgaagaagtgtggacttacactcggagatgcctggc

SEQ ID NO: 118064 - DNA, 201 bp, Bos taurus
cggccaccgcccctggtaggcctgacctaatcaggaagtggattctgctctacccagttagctcagaagataagatggcagcctcagctgacaccttgtgrgaccctgagtagaaggcccagttaaattgtgtccagattcctaagccacagaaactgtaaaatgataagatgttgagctgttaaactagtggtgattttt

SEQ ID NO: 118065 - DNA, 201 bp, Bos taurus
gaagctaagacctgaggcttagtaaacttggccacacatagaggagggaagagaattcagtgcagagggagggaagaaagttctcagcagataaatgagcrtgtgcaaaaggcccctgagtcaacaataaaataatgcatttgagacaatgaaagaacatgagggccctgagaacccttggggaatggggagagacaggtg

SEQ ID NO: 118066 - DNA, 201 bp, Bos taurus
tcgtgcttctattgcattggcttcaaacttgattcctctaaatgatgggccaaggatactccaatgagttttgtgccactgtctttgaaagacttgcatamctgctctaaaccctgttttagaatctgggatagttggtctattgttccaggtctttgaagccagaaaaagggcattttaagcatctgttacatgaccaac

SEQ ID NO: 118067 - DNA, 201 bp, Bos taurus; identical to SEQ ID NO: 37047

SEQ ID NO: 118068 - DNA, 201 bp, Bos taurus; identical to SEQ ID NO: 37048

SEQ ID NO: 118069 - DNA, 201 bp, Bos taurus
atcccatcccaggattttcagctcttcctggaagttggttctgctcttctccggtctagtaaataatcgaacagaagagaaacagtgagatgcggagcagygtatctgcctggactgcagggcctgtctgcatctggctgtacaaggcgcacatgcagagcagacacaggcaaggagtgagcgtgactgactgaccggccc

SEQ ID NO: 118070 - DNA, 201 bp, Bos taurus
aatatcaggccaaatatgttgctacaaagatattttaagattagattaacatttaaatcagtagattctgagtaaagcagactacccttcataatgtggaygggcctcacccaattagttgatgaccttaataaaaaaacaagtattctctcaccccctcctccccaccaggaagagagaattctgtctccagactgcctg

SEQ ID NO: 118071 - DNA, 201 bp, Bos taurus
tgtttccctgtcattactcatgatcaaagtattgcacacctctgaaggtcaccaatcacattatagtctcagtgactgagccacaggtgtcttttgagccmaacaaccaatatttaaatttttaaaattttatttggccgcatcaggtcttagttgcagcactcaggatcttcactatgtcacgcaggatccttctttgta

SEQ ID NO: 118072 - DNA, 201 bp, Bos taurus; identical to SEQ ID NO: 37051

SEQ ID NO: 118073 - DNA, 201 bp, Bos taurus; identical to SEQ ID NO: 37053

SEQ ID NO: 118074 - DNA, 201 bp, Bos taurus
agtctcccttcttcctcagggcattaggggccctccaggctctaaggaggaggcatatgtagtgagtcattagtggatatgactggtcttatgtctgtccrtattataatctgcaataaaaggggggttaggtatataagcccaataagtataattaatcaagtcagcctgagagggggaagcaaaagcaagcagagcaag

SEQ ID NO: 118075 - DNA, 201 bp, Bos taurus
cacagaggggacatgcaggaagcgtcccacccaatccacccattcccacattctcattctcccttctgcagtcaacgtcccagccaggtcaaagacacacrctttgtgtgtgtcattgagagcagggatggaggggtatgtcctgcaattctggcttgatctcccttcagagaacaaaggaaagcagagagaacgacttct

SEQ ID NO: 118076 - DNA, 201 bp, Bos taurus
acacgtaccctccccaggctgtctcctgaggcctgctccttggtttctgtgacccagttgcactgaccttgcagttccccaagttcactaatttcatggaytagatagaccagagggccctgggaagcagaccagtccaccagacaaattcctggtccctgtctgcctgtttgctttctggtcccttggaccctgggaaaa

SEQ ID NO: 118077 - DNA, 201 bp, Bos taurus
ttctgctagagcgactcattgtcagtccccacgggaagcagctgcaggctcttaagtgctcaagaaacttcagattacaggcaaagacacaaagctggccytggactcttaaaataagagctacttacctcaaacagggctccctgggctgctgagctgctccacatgcaggcctggggcgagtgcctccttcccaggctg

SEQ ID NO: 118078 - DNA, 201 bp, Bos taurus
tgccacagaaaccatccaggacagtccggctccttcttctgtcgcctaagtggcagttcattactactaccatttgctaaataacacagcacaagcttgaygtgggacgggtccttggagcaggaagcggtgactttgctctcaggccaagtcctgtggggtgaggacagacccggggtgataggggagacgcccgcctgg

SEQ ID NO: 118079 - DNA, 201 bp, Bos taurus
agaggggccaggaaaaccccactgcctggagcctgtgtaaatcagagtgctgtgagtagcttaggtaccccgaacccttccctcattcccagcaaacctcyttgaggaaggccgaggttaagagcggtaacaaaccacaggtcagcacacaggtcacttagcgcttgcacacctccccagagacacgcagggccctgcaga

SEQ ID NO: 118080 - DNA, 201 bp, Bos taurus; identical to SEQ ID NO: 37056

SEQ ID NO: 118081 - DNA, 201 bp, Bos taurus
ggagccaggaagggaggcgtccgggccttgaccacaggcagcccaatgccagcagtcacatggtagactgttatgctgtgctgccttccctgcccgtgctratgggaccaaagccccatgggcccacaacacacagagcctgtcatttctacttcatgtttatgcacggtgctcagccaccttcagtttaacctttgcttt

SEQ ID NO: 118082 - DNA, 201 bp, Bos taurus; identical to SEQ ID NO: 37058

SEQ ID NO: 118083 - DNA, 201 bp, Bos taurus; identical to SEQ ID NO: 37060

SEQ ID NO: 118084 - DNA, 201 bp, Bos taurus; identical to SEQ ID NO: 37061

SEQ ID NO: 118085 - DNA, 201 bp, Bos taurus; identical to SEQ ID NO: 37062

SEQ ID NO: 118086 - DNA, 201 bp, Bos taurus; identical to SEQ ID NO: 37064

SEQ ID NO: 118087 - DNA, 201 bp, Bos taurus; identical to SEQ ID NO: 37065

SEQ ID NO: 118088 - DNA, 201 bp, Bos taurus; identical to SEQ ID NO: 37066

SEQ ID NO: 118089 - DNA, 201 bp, Bos taurus; identical to SEQ ID NO: 37069

SEQ ID NO: 118090 - DNA, 201 bp, Bos taurus; identical to SEQ ID NO: 76763

SEQ ID NO: 118091 - DNA, 201 bp, Bos taurus
gagtacatgcccttgccttttctagcttctagaatttgtctgcttttcttggctcctccatcagtgaaagccagcaactttgggccaagttcttcttagcyggctgtctggtcctccctcctttgccttcctccttttttttttttcccctgttttacttttgaggacccttgttacatttggcccacctaggtaattcaa

SEQ ID NO: 118092 - DNA, 201 bp, Bos taurus; identical to SEQ ID NO: 37071

SEQ ID NO: 118093 - DNA, 201 bp, Bos taurus; identical to SEQ ID NO: 37072

SEQ ID NO: 118094 - DNA, 201 bp, Bos taurus; identical to SEQ ID NO: 37073

SEQ ID NO: 118095 - DNA, 201 bp, Bos taurus; identical to SEQ ID NO: 37074

SEQ ID NO: 118096 - DNA, 201 bp, Bos taurus
cttgacctggggctgtcaggcaggccctgagcattgagtactgaccccaaagctgtcacactaggtcatcaagaaccggacagaagattcttcctgccctkgaggggcttacagcaaggccctgcgagagtgaccctaagcaacaagcaggcatattcctcccgcctccaaggaagggcctgggctcagcggtcaaaacag

SEQ ID NO: 118097 - DNA, 201 bp, Bos taurus
ttctgtatcaagtcagctcatgactattcttcctggtgtaaaactaactgagagattcaattggacaggagagactcaatttgtcatcatgagactagacmagcagtgcactcctcagctaaatagagaatattcactagacacaaaattgaccgtaagctgtaaatgggaaataagtttaaaatggctggtacaagtaga

SEQ ID NO: 118098 - DNA, 201 bp, Bos taurus
cagctaagtatttgggactcaattgcaattcaccttgaattactacaatcaattcctattgcaaaggaagactgccttacttttaaaaaggaccattcaarctttctattaagtaggaagattatgattgcatgtctcttcttccctctgaagaattgattaaactttaagcatctcacattaaattaaaggaaaaaaaaa

SEQ ID NO: 118099 - DNA, 201 bp, Bos taurus
tttcgtgcgctcctgcaccatggcagccgccactgtgtcctgtcactgtttaacacctgcctccttccactagatacaagggttttacttccttcactgcratggcctctcaatgcttgagaaaagtttgtggaagagacggatgaaaagttggatagggctcagccttcccatcttaaccttgctcactccaccgggaga

SEQ ID NO: 118100 - DNA, 201 bp, Bos taurus
atacgtctttgtgcatttctttaactaataccatagtagttggatcacatacttttgaaatgaaaagatgaaggtttaggcactaaattctgttgtctgcyttgatcacacaagttgtatgaaaagaatatttaaaacttttaagtgtcaaattaattattcatgtattatctaaaagtatatatgcatattatatttata

SEQ ID NO: 118101 - DNA, 201 bp, Bos taurus
tacaaatctgacaacaaaagaatttcacaacagataggtggctgaagcatgaggtaccaacataagcccaagtatttcatggccacttgggagtcccgaargacagtatttaatgtccttaaagaaaaaatagcttttctattctaggcaagttgatctgaaggcccagcatcagtaagactgaagccagtgaacaattta

SEQ ID NO: 118102 - DNA, 201 bp, Bos taurus; identical to SEQ ID NO: 76765

SEQ ID NO: 118103 - DNA, 201 bp, Bos taurus
cattatacttcattatggttaagaggttatcacctcaaaggactggaacgtgtctcaggcaagatacttttagcagtgtctcatctatgaggccaggtatycagcaagtccagcttcccagagcatcagaggggagtgtcagagctccatggcgggcactaagtcacaccaacgccacaggcctacttaagccctaagcaa

SEQ ID NO: 118104 - DNA, 201 bp, Bos taurus
ttgatggtaaagaaatattatcacattaatttttttatttatgagtctgttccgatttaaaaaaaaaaaaagagagagagagtgggggtaaggcaagctcktctttactcaagaaggcctctacccaatgcaggggaacgacaattagaaaaagtacaattttgcaaacactggtgcaatacttgattaagacaaggcgta

SEQ ID NO: 118105 - DNA, 201 bp, Bos taurus; identical to SEQ ID NO: 37078

SEQ ID NO: 118106 - DNA, 201 bp, Bos taurus; identical to SEQ ID NO: 37079

SEQ ID NO: 118107 - DNA, 201 bp, Bos taurus; identical to SEQ ID NO: 37080

SEQ ID NO: 118108 - DNA, 201 bp, Bos taurus; identical to SEQ ID NO: 37081

SEQ ID NO: 118109 - DNA, 201 bp, Bos taurus
ccctggggagaaggaggagctgagcctcaggatggactagaaagttgtccagtgcctaagcaggctttgtgctggatgtccggcctcacttctctctgtgygtctgccttagccttctctactttctttcagattggcttttcctgcctcacatgtacatggccaaatgtggctatcagcttcttgacaacccagctcacc

SEQ ID NO: 118110 - DNA, 201 bp, Bos taurus; identical to SEQ ID NO: 76770

SEQ ID NO: 118111 - DNA, 201 bp, Bos taurus
tgggcaccagaggccagcgcccctctcagcaacctgggaagcaccgttagcattcctgtggctgctccagctgcttgtgggctgacactgtgacctcatcrgagaggggcctggggcctaaagagcctccagatttttgacaagatgacacgtacaacgagaaagcagctacacggctccccctccaaacttgaacctgct

SEQ ID NO: 118112 - DNA, 201 bp, Bos taurus; identical to SEQ ID NO: 37083

SEQ ID NO: 118113 - DNA, 201 bp, Bos taurus; identical to SEQ ID NO: 76772

SEQ ID NO: 118114 - DNA, 201 bp, Bos taurus
ggactgaggtctcagctcctcttctggccaccagtcagggctgttctccattcccacaggctgcccacaaccctcctccagggggcccctccaccttccarttggcatgcttatcaattcttctctcaactttcacttccgccaccagccagagaacactctacttttaaaggaattgcttgattagatggggcccacccc

SEQ ID NO: 118115 - DNA, 201 bp, Bos taurus; identical to SEQ ID NO: 37085

SEQ ID NO: 118116 - DNA, 201 bp, Bos taurus; identical to SEQ ID NO: 37088

SEQ ID NO: 118117 - DNA, 201 bp, Bos taurus; identical to SEQ ID NO: 76775

SEQ ID NO: 118118 - DNA, 201 bp, Bos taurus; identical to SEQ ID NO: 76776

SEQ ID NO: 118119 - DNA, 201 bp, Bos taurus; identical to SEQ ID NO: 76777

SEQ ID NO: 118120 - DNA, 201 bp, Bos taurus; identical to SEQ ID NO: 76778

SEQ ID NO: 118121 - DNA, 201 bp, Bos taurus; identical to SEQ ID NO: 76781

SEQ ID NO: 118122 - DNA, 201 bp, Bos taurus; identical to SEQ ID NO: 37091

SEQ ID NO: 118123 - DNA, 201 bp, Bos taurus; identical to SEQ ID NO: 37092

SEQ ID NO: 118124 - DNA, 201 bp, Bos taurus; identical to SEQ ID NO: 37093

SEQ ID NO: 118125 - DNA, 201 bp, Bos taurus; identical to SEQ ID NO: 37094

SEQ ID NO: 118126 - DNA, 201 bp, Bos taurus
ctatgggaaatgattgattttcaaagtagaagaaaagaaggcatgggtaccagagctgatgggtgggggcaccccactcagggggcaacagtgaacaaccractggggaagccaggggtcattaagtgtgctttctacacaggggacttgtcccactgccttcctccccttcctctctgccctgatatcagccacaagcag

SEQ ID NO: 118127 - DNA, 201 bp, Bos taurus; identical to SEQ ID NO: 37095

SEQ ID NO: 118128 - DNA, 201 bp, Bos taurus
tgcactcaccaccacagcctggcctcgctctgtggctgggaacccaagcctccctccaagcgattgcgggccaaggccacctgagataagtagtgtatgtrtgtcaatgctgctctctcaattcatccttttccctttctttttgttaattgcaatgaggaaacagaggacaacagggcctaacccactcaagttcagttc

SEQ ID NO: 118129 - DNA, 201 bp, Bos taurus; identical to SEQ ID NO: 76784

SEQ ID NO: 118130 - DNA, 201 bp, Bos taurus; identical to SEQ ID NO: 37100

SEQ ID NO: 118131 - DNA, 201 bp, Bos taurus; identical to SEQ ID NO: 37101

SEQ ID NO: 118132 - DNA, 201 bp, Bos taurus; identical to SEQ ID NO: 76790

SEQ ID NO: 118133 - DNA, 201 bp, Bos taurus; identical to SEQ ID NO: 37103

SEQ ID NO: 118134 - DNA, 201 bp, Bos taurus
aacaagtaagtgggtaaacaagtgagtgaatgagtgagtgaaggaatgaatgaattccccccaagagtattccatggcccacttaggatggcccacagacrataatttttctcttagacctatgcactgggaaaacgttagcctgtgttgagaaactgatgttcactcattcacttattcagtgtatttatggagaaccca

SEQ ID NO: 118135 - DNA, 201 bp, Bos taurus; identical to SEQ ID NO: 37107

SEQ ID NO: 118136 - DNA, 201 bp, Bos taurus; identical to SEQ ID NO: 37110

SEQ ID NO: 118137 - DNA, 201 bp, Bos taurus; identical to SEQ ID NO: 37111

SEQ ID NO: 118138 - DNA, 201 bp, Bos taurus
aggcacagcacctgcctccctgtcccacctggagaagcctcgccagcaacttgtgacagatggcagcactttgagtgactacttcaattttaactcctttygataatccagcgccagaaagccacatactttaaaactgtccccggatcatagatcaaccccaaaggccaagtccagctcagttaataacctctggaaaca

SEQ ID NO: 118139 - DNA, 201 bp, Bos taurus
gctcaagatttaaaactgccttggtgtcactgtttgggtcaccagattcatccacaggaaggttcacatttctgttcaaaacagtcataaagtttaacacrttgaacatctgaggcctttatttctcagtttggcctgcaaatctatgccaagaaagagaaggagcgtgggagggaggaggggcctggagtgagcgcacac

SEQ ID NO: 118140 - DNA, 201 bp, Bos taurus; identical to SEQ ID NO: 76797

SEQ ID NO: 118141 - DNA, 201 bp, Bos taurus; identical to SEQ ID NO: 76800

SEQ ID NO: 118142 - DNA, 201 bp, Bos taurus
gtgaggagggaggaaggatgaacggactgatgtgagagcggccagcgggatgctgctgaagcaggaggaagtgggcagtgccaaggagtgggattaagcayacagacaaagagccagatggcctgcattagagtcctgggctttgtactgcttggcattgtgaccttgtacaaattcttcaacttctatatttctctgggg

SEQ ID NO: 118143 - DNA, 201 bp, Bos taurus; identical to SEQ ID NO: 76801

SEQ ID NO: 118144 - DNA, 201 bp, Bos taurus
ttgataagttttgtcttgataactagggtcacagagtttctgtcctatactcgtcgaagccattaaagtcttgttagattgacttactctgtattgttcayctgtgatgtacccatctccaaagacaggttagcaaagtggtaccccgtgtttcacaatgagattattacagcttttagtgcttttgtcatctctacaact

SEQ ID NO: 118145 - DNA, 201 bp, Bos taurus; identical to SEQ ID NO: 37112

SEQ ID NO: 118146 - DNA, 201 bp, Bos taurus; identical to SEQ ID NO: 37113

SEQ ID NO: 118147 - DNA, 201 bp, Bos taurus; identical to SEQ ID NO: 37114

SEQ ID NO: 118148 - DNA, 201 bp, Bos taurus; identical to SEQ ID NO: 37115

SEQ ID NO: 118149 - DNA, 201 bp, Bos taurus; identical to SEQ ID NO: 76807

SEQ ID NO: 118150 - DNA, 201 bp, Bos taurus; identical to SEQ ID NO: 37118

SEQ ID NO: 118151 - DNA, 201 bp, Bos taurus; identical to SEQ ID NO: 76808

SEQ ID NO: 118152 - DNA, 201 bp, Bos taurus; identical to SEQ ID NO: 76809

SEQ ID NO: 118153 - DNA, 201 bp, Bos taurus; identical to SEQ ID NO: 37120

SEQ ID NO: 118154 - DNA, 201 bp, Bos taurus; identical to SEQ ID NO: 37121

SEQ ID NO: 118155 - DNA, 201 bp, Bos taurus
acattcaggtcggatgatagccatgcccatgaagatgtccacacgaggatgggcctccctgtctgttctcctagacgtgcaatattggccttcaagtttcyggtcacagacttgtagaactggaaagagacacgtagagcctttgcagtgtttcttattctcttttggatcactggcccttttgagaaacttctgaaatgt

SEQ ID NO: 118156 - DNA, 201 bp, Bos taurus
cagcagagcagctgtcttttctagacctgagttctgcaagcagcctcacagttccagaatgtgggaggtggcagataaccagtttgtttggttgtagaacytgatctcatagtaactttaatggttgaaagtcacccccacttcatttttacccccatgtgatttcttcagccccttgagttatagaggaggaggtgttct

SEQ ID NO: 118157 - DNA, 201 bp, Bos taurus
tatccgcgccgcggtgatgtgaatgtctgcctgcttcctcaccctgctgctccttgcaccactttccagagaagaagtgcaacgggttccgctgcccgaayggcacctgcatcccatccagcaaacactgcgacggtctgcacgactgctccgacggctcggacgaacagcactgcggtgagtcctcacgtcgggctaaat

SEQ ID NO: 118158 - DNA, 201 bp, Bos taurus
tcctttttacagctggtaactgaggcataaagtgataagttaccctctgggtggatctgggacttgaacctggctctttgtttcactaaagggcagaggtyctttgagggtggagcaatcacatgtgattcctgatccatccttctgggagggacatagcagaatactgcactgttaaaggtgctcagcaacatctctatc

SEQ ID NO: 118159 - DNA, 201 bp, Bos taurus; identical to SEQ ID NO: 76817

SEQ ID NO: 118160 - DNA, 201 bp, Bos taurus
cattcttaggtctttgaagattcaccgtgatagcctgactgtctacccccattcctctggactgttcagtttatggacttctgggtctatatgctcaagtytgcaaggggttcacctgcaagcatgccgattctgattctactgtgcttagaactgtgcctgccacgtaacgggtgctttacaaattattgctcattctgt

SEQ ID NO: 118161 - DNA, 201 bp, Bos taurus
ggcggtcagcagcctgcatgctgcaactggagagtggcccccgattgccaccagagaacagcccaagaatcaacaaagacacagcatggccaaaagttttwaaaaatgataataataaccaccaaagacaattttgagtatggtagtttaaccccaggtcctatgttgaaatattttagaggccctacatatttttaaatg

SEQ ID NO: 118162 - DNA, 201 bp, Bos taurus
tggcattacaaaacttcccctctttgtataggtcataagttatttatgttgacattatgtattatgcatgatttggaaatacatctaacatcaatgtacayggcctcacaaagattcattaaaatgcattctatgaagttttaaacttccatttttaaacagaaatatccaaaaaaattgtatcttgtaatccctgaaacc

SEQ ID NO: 118163 - DNA, 201 bp, Bos taurus
ttcgtcactgggaaaatgaaagcacattgctgcatgtctcaccgtaggcctgtgctggacctatcctgcagaggattctgttaacatcatcaagaagcackagggggctttaggaggtggctcttgtttcttttcttccttcctaaacatttcatacaaatatttgaaactgattttttaggagaaagtctttcttttctg

SEQ ID NO: 118164 - DNA, 201 bp, Bos taurus; identical to SEQ ID NO: 37128

SEQ ID NO: 118165 - DNA, 201 bp, Bos taurus
ggggtatcagggaaggcttcctggaggaagttatattttggccaagagtagaccagtgaatgggattggtcagagtaggtaaagtgaagagtttccaggcmaagaatggcgtgtgcatggacccagagcatgtggcccaacaacagacctgaaaacatacagtctaacgagagcaggaggaactaaagaggcagaaaacaa

SEQ ID NO: 118166 - DNA, 201 bp, Bos taurus; identical to SEQ ID NO: 76821

SEQ ID NO: 118167 - DNA, 201 bp, Bos taurus; identical to SEQ ID NO: 76822

SEQ ID NO: 118168 - DNA, 201 bp, Bos taurus
aggcgggagcccatacttcgccattgtctgaagggctgggggatggacctccagccaaagaaagcagatggagaccaagcctctgctggacacccagcctytacccacctggcccaggaatccactctgagtgggaattctaggtctgcagaaatctgggacacccagtttagccctcttgaaggggagggaatcacactc

SEQ ID NO: 118169 - DNA, 201 bp, Bos taurus; identical to SEQ ID NO: 76823

SEQ ID NO: 118170 - DNA, 201 bp, Bos taurus; identical to SEQ ID NO: 37129

SEQ ID NO: 118171 - DNA, 201 bp, Bos taurus; identical to SEQ ID NO: 37130

SEQ ID NO: 118172 - DNA, 201 bp, Bos taurus; identical to SEQ ID NO: 37131

SEQ ID NO: 118173 - DNA, 201 bp, Bos taurus; identical to SEQ ID NO: 37132

SEQ ID NO: 118174 - DNA, 201 bp, Bos taurus; identical to SEQ ID NO: 37133

SEQ ID NO: 118175 - DNA, 201 bp, Bos taurus; identical to SEQ ID NO: 76827

SEQ ID NO: 118176 - DNA, 201 bp, Bos taurus; identical to SEQ ID NO: 76828

SEQ ID NO: 118177 - DNA, 201 bp, Bos taurus; identical to SEQ ID NO: 76829

SEQ ID NO: 118178 - DNA, 201 bp, Bos taurus; identical to SEQ ID NO: 37134

SEQ ID NO: 118179 - DNA, 201 bp, Bos taurus; identical to SEQ ID NO: 37135

SEQ ID NO: 118180 - DNA, 201 bp, Bos taurus; identical to SEQ ID NO: 76831

SEQ ID NO: 118181 - DNA, 201 bp, Bos taurus; identical to SEQ ID NO: 37136

SEQ ID NO: 118182 - DNA, 201 bp, Bos taurus; identical to SEQ ID NO: 76832

SEQ ID NO: 118183 - DNA, 201 bp, Bos taurus; identical to SEQ ID NO: 76834

SEQ ID NO: 118184 - DNA, 201 bp, Bos taurus; identical to SEQ ID NO: 76835

SEQ ID NO: 118185 - DNA, 201 bp, Bos taurus; identical to SEQ ID NO: 76836

SEQ ID NO: 118186 - DNA, 201 bp, Bos taurus; identical to SEQ ID NO: 76837

SEQ ID NO: 118187 - DNA, 201 bp, Bos taurus; identical to SEQ ID NO: 76838

SEQ ID NO: 118188 - DNA, 201 bp, Bos taurus; identical to SEQ ID NO: 37137

SEQ ID NO: 118189 - DNA, 201 bp, Bos taurus; identical to SEQ ID NO: 37138

SEQ ID NO: 118190 - DNA, 201 bp, Bos taurus; identical to SEQ ID NO: 37139

SEQ ID NO: 118191 - DNA, 201 bp, Bos taurus; identical to SEQ ID NO: 37140

SEQ ID NO: 118192 - DNA, 201 bp, Bos taurus; identical to SEQ ID NO: 37141

SEQ ID NO: 118193 - DNA, 201 bp, Bos taurus; identical to SEQ ID NO: 37142

SEQ ID NO: 118194 - DNA, 201 bp, Bos taurus; identical to SEQ ID NO: 37143

SEQ ID NO: 118195 - DNA, 201 bp, Bos taurus
tggcattgtctctgaggtgtaaaataactgtggcttactaagtgataatgtgcttcatttgtctttttttttttttaataattatttatgttaaactcttrtaggatgaagcagcagcacagccgctgaatctctcatcccgacccaagacagttgagcctgtaaagtccccaacatctcccacccagagcctcttctcag

SEQ ID NO: 118196 - DNA, 201 bp, Bos taurus; identical to SEQ ID NO: 37144

SEQ ID NO: 118197 - DNA, 201 bp, Bos taurus; identical to SEQ ID NO: 76851

SEQ ID NO: 118198 - DNA, 201 bp, Bos taurus; identical to SEQ ID NO: 76852

SEQ ID NO: 118199 - DNA, 201 bp, Bos taurus; identical to SEQ ID NO: 37147

SEQ ID NO: 118200 - DNA, 201 bp, Bos taurus; identical to SEQ ID NO: 76855

SEQ ID NO: 118201 - DNA, 201 bp, Bos taurus; identical to SEQ ID NO: 76856

SEQ ID NO: 118202 - DNA, 201 bp, Bos taurus; identical to SEQ ID NO: 37149

SEQ ID NO: 118203 - DNA, 201 bp, Bos taurus; identical to SEQ ID NO: 37152

SEQ ID NO: 118204 - DNA, 201 bp, Bos taurus; identical to SEQ ID NO: 76860

SEQ ID NO: 118205 - DNA, 201 bp, Bos taurus
aatgaattcagtgcttttctgtgtataggaagatgcaataatctgggctcattaaaagtattcctttgatatgcaccttagctatctagggccagcattcygcttttttgcatcctaaatcccctcagggcaacaggggcaactgcaatggctcctgacttgatggccctaacattctttgctgattgatatggcaggtga

SEQ ID NO: 118206 - DNA, 201 bp, Bos taurus
ctaacagacaggcccagcattctttggcagcaccccagatgtagtgtatgtgacagtgccttctggtttctctagtgttttatggaatttcctttgcattkctgggtcttgtcctgggcccaactttcaagacaacaaaggacaaatagcctagtgatcctgtcctaccttggcatcaccttttctccctttcaaatccta

SEQ ID NO: 118207 - DNA, 201 bp, Bos taurus; identical to SEQ ID NO: 37156

SEQ ID NO: 118208 - DNA, 201 bp, Bos taurus
ttcagcatctccggcctggccgggagagtggaggtcggtagtctgctgccggtgcgacctttccctggggtttgtttcgctttccaccgggccttgaacartatcttctcggtctaccagccaatttcgctcctcaggttccttcagtcgagtagattccgagcagtccagagagggccctagtggtctgtgtgggagaaa

SEQ ID NO: 118209 - DNA, 201 bp, Bos taurus; identical to SEQ ID NO: 37157

SEQ ID NO: 118210 - DNA, 201 bp, Bos taurus
taggaacctcttcagtcctgggcaaagtaggatggttgatcaccctataggagaaggacaagaaagatcaccatgaaatcctcatggaggtgcaatgaagrgggtaagatgggagggggtaaggatgcattaatttcattcatgaagaaaccacatgtggatcaagacagttagcagtaaggaccaaaaggagggaatgaa

SEQ ID NO: 118211 - DNA, 201 bp, Bos taurus; identical to SEQ ID NO: 37160

SEQ ID NO: 118212 - DNA, 201 bp, Bos taurus; identical to SEQ ID NO: 37162

SEQ ID NO: 118213 - DNA, 201 bp, Bos taurus; identical to SEQ ID NO: 37163

SEQ ID NO: 118214 - DNA, 201 bp, Bos taurus; identical to SEQ ID NO: 37168

SEQ ID NO: 118215 - DNA, 201 bp, Bos taurus
aaaagaagatgtcaaatatggcatttgtgacctttggatgtagggcagtgcttttcaagcaggggcaattctgtggcccatgggacatttggcactgtctrgagacacttgggattgtgacaagtggggaaagagtgtgtctagtgggcagaggccagggatgctgcgaaacctcctacaaggcacaggacagccctacac

SEQ ID NO: 118216 - DNA, 201 bp, Bos taurus; identical to SEQ ID NO: 76873

SEQ ID NO: 118217 - DNA, 201 bp, Bos taurus; identical to SEQ ID NO: 76874

SEQ ID NO: 118218 - DNA, 201 bp, Bos taurus; identical to SEQ ID NO: 37169

SEQ ID NO: 118219 - DNA, 201 bp, Bos taurus; identical to SEQ ID NO: 76879

SEQ ID NO: 118220 - DNA, 201 bp, Bos taurus; identical to SEQ ID NO: 37172

SEQ ID NO: 118221 - DNA, 201 bp, Bos taurus
tcaggcccctagtagacatcgaggcaacagcattcccagactttttcaccagctgccttggctgtgtgaacttctctctcgataatcatcccttatcccayatcccagtgtggccctgcttcccctatcaagccctaactgatacactaggtaaatgagactgccactcctcatgggcctacagtggacctgtcattactt

SEQ ID NO: 118222 - DNA, 201 bp, Bos taurus; identical to SEQ ID NO: 76880

SEQ ID NO: 118223 - DNA, 201 bp, Bos taurus; identical to SEQ ID NO: 76881

SEQ ID NO: 118224 - DNA, 201 bp, Bos taurus; identical to SEQ ID NO: 37174

SEQ ID NO: 118225 - DNA, 201 bp, Bos taurus; identical to SEQ ID NO: 37175

SEQ ID NO: 118226 - DNA, 201 bp, Bos taurus; identical to SEQ ID NO: 37176

SEQ ID NO: 118227 - DNA, 201 bp, Bos taurus; identical to SEQ ID NO: 37177

SEQ ID NO: 118228 - DNA, 201 bp, Bos taurus; identical to SEQ ID NO: 37180

SEQ ID NO: 118229 - DNA, 201 bp, Bos taurus; identical to SEQ ID NO: 37181

SEQ ID NO: 118230 - DNA, 201 bp, Bos taurus
ctgtcttctgctgggctcagtcaggcagctgtggccagttgctggttagctggttgagtcagcttctggaggtgggttgactgactgctggagtcatggtrcttctgggccgtgagtggtttctcatccagtaggctactccaggctgcttcacatgatgctggtgacagggattctaagggcagcaagaaacagcaagca

SEQ ID NO: 118231 - DNA, 201 bp, Bos taurus; identical to SEQ ID NO: 37191

SEQ ID NO: 118232 - DNA, 201 bp, Bos taurus
agagaattttacggactgtatagtccatcgggtcacaaagagtcagacacagctgagcaactttcactttcactttggaggttctgggggttacaacttgrcaaaacctttgggggccactataaaacctgctgcaatctggtaagaaaagaaataataataccactattttacagatgagaaaactgaggcatagagatt

SEQ ID NO: 118233 - DNA, 201 bp, Bos taurus
tcctggcttggcggctcgggattttgctagaacacccgtatcttcgaaagtgtgtttatgtgggtcggcgacgagggccatagggttttcccaaagtgccrtggagtataagttgaaacatagctataaactttgccaaatgttggcatctatttttttccccctgggaacctggggttcgtttacttactgttgaaggcc

SEQ ID NO: 118234 - DNA, 201 bp, Bos taurus
aagtgaactattgtactttacttaaaggaagtgggtggtagtattaatattaagcaagatggactctttctgatggccagaactatatgtagattcaattwaattacttcatattagaaatttagttaagaataagtggtgtagtgtggaaggacaagaaaaagtctccaccatcaggcctcgttgagaactggatgaatg

SEQ ID NO: 118235 - DNA, 201 bp, Bos taurus; identical to SEQ ID NO: 37193

SEQ ID NO: 118236 - DNA, 201 bp, Bos taurus; identical to SEQ ID NO: 37194

SEQ ID NO: 118237 - DNA, 201 bp, Bos taurus; identical to SEQ ID NO: 76901

SEQ ID NO: 118238 - DNA, 201 bp, Bos taurus; identical to SEQ ID NO: 37196

SEQ ID NO: 118239 - DNA, 201 bp, Bos taurus; identical to SEQ ID NO: 37197

SEQ ID NO: 118240 - DNA, 201 bp, Bos taurus; identical to SEQ ID NO: 37198

SEQ ID NO: 118241 - DNA, 201 bp, Bos taurus; identical to SEQ ID NO: 37199

SEQ ID NO: 118242 - DNA, 201 bp, Bos taurus; identical to SEQ ID NO: 37201

SEQ ID NO: 118243 - DNA, 201 bp, Bos taurus; identical to SEQ ID NO: 37202

SEQ ID NO: 118244 - DNA, 201 bp, Bos taurus
ggtgtatattaatataatccctaataactttttctaaatgcttgcttcagggactatatctggaactgaacatagccacagcgctgtggtatggccacccytgctctacactctggtctcttcaagaggtgaacatagcagtcattatcctggtaaggcatgtagattagtaatcaccattctgttacctgcagagaaata

SEQ ID NO: 118245 - DNA, 201 bp, Bos taurus; identical to SEQ ID NO: 76907

SEQ ID NO: 118246 - DNA, 201 bp, Bos taurus
ctaatacatgctgtcatgcttgaccacctacctaaattctccaagctttctttaacctcctttatgcactttttttttgtgcccattaaatacccttcttyctcttgtctgcctaatgagttcaggcataagctcatctctgaagccttttctgatgaagactgagactgagttgttttgtgttccttgtgttcctctggt

SEQ ID NO: 118247 - DNA, 201 bp, Bos taurus; identical to SEQ ID NO: 37204

SEQ ID NO: 118248 - DNA, 201 bp, Bos taurus; identical to SEQ ID NO: 37205

SEQ ID NO: 118249 - DNA, 201 bp, Bos taurus
cctgtagtacttcctaaggccaggtattattctgaatattttccttcccacagctggagaggcaaggggtcctgctggtggaatttgaggctccccttgcsacaggcccagagctgccagcccagcggcagagcgtggtcttagaggaagatgtcattcagttctcgccaaccatggaattctcactgcgacctggggaca

SEQ ID NO: 118250 - DNA, 201 bp, Bos taurus; identical to SEQ ID NO: 37208

SEQ ID NO: 118251 - DNA, 201 bp, Bos taurus; identical to SEQ ID NO: 37209

SEQ ID NO: 118252 - DNA, 201 bp, Bos taurus; identical to SEQ ID NO: 37210

SEQ ID NO: 118253 - DNA, 201 bp, Bos taurus; identical to SEQ ID NO: 37211

SEQ ID NO: 118254 - DNA, 201 bp, Bos taurus; identical to SEQ ID NO: 76914

SEQ ID NO: 118255 - DNA, 201 bp, Bos taurus
taatgaagcaaaatagattaaaggggaaagacaaggagttcagaaatttgtagagtagtatcacatcccctttttccatcttttttcatctgtgacatccytaggtcccacatccattcctcacgtgatgtagtcacaagtatgtaagttggccctcttagaaggcaaacagtagcaagtgtgagccagttagctcatgga

SEQ ID NO: 118256 - DNA, 201 bp, Bos taurus; identical to SEQ ID NO: 76916

SEQ ID NO: 118257 - DNA, 201 bp, Bos taurus; identical to SEQ ID NO: 37220

SEQ ID NO: 118258 - DNA, 201 bp, Bos taurus
cactctccacagctgccgaaggtatctttgaaaaatataagtcagatcatttccctgtctgcttaaaactcaccagtgacttcccatctgactcagagtaragctcagctctaccttccaggccatccggggctgccggcccactgcctctctgccttgatttctgcaaactcccctactttgagcattttgttcagctac

SEQ ID NO: 118259 - DNA, 201 bp, Bos taurus; identical to SEQ ID NO: 37222

SEQ ID NO: 118260 - DNA, 201 bp, Bos taurus
gtgcaaactgcaaggattattaaggggtattaacttgggtctgcagggaccataccattattaaggtactgagccaggtaaacagatcactccaaggcctyaactctaagaagtccatcgaattagggcatggtaactgccaagtggcataactggattctactgtaactgacataaagagaggaacatatttaaaaggac

SEQ ID NO: 118261 - DNA, 201 bp, Bos taurus
ctaacttggcccagtgcattcattcattaaaccacgatatgctgtgaatctatgttctagggacgagtatggcactagagatgaaacacggctatagtttkgtccctcctatctgagggcctctgctttgggtcttctatctgtatcccctttactaagcatgcgcttggccaataatgctcagaaatcaggtaattgaat

SEQ ID NO: 118262 - DNA, 201 bp, Bos taurus; identical to SEQ ID NO: 37227

SEQ ID NO: 118263 - DNA, 201 bp, Bos taurus; identical to SEQ ID NO: 37228

SEQ ID NO: 118264 - DNA, 201 bp, Bos taurus; identical to SEQ ID NO: 37230

SEQ ID NO: 118265 - DNA, 201 bp, Bos taurus; identical to SEQ ID NO: 37231

SEQ ID NO: 118266 - DNA, 201 bp, Bos taurus; identical to SEQ ID NO: 37233

SEQ ID NO: 118267 - DNA, 201 bp, Bos taurus; identical to SEQ ID NO: 37234

SEQ ID NO: 118268 - DNA, 201 bp, Bos taurus; identical to SEQ ID NO: 37238

SEQ ID NO: 118269 - DNA, 201 bp, Bos taurus; identical to SEQ ID NO: 76940

SEQ ID NO: 118270 - DNA, 201 bp, Bos taurus; identical to SEQ ID NO: 76941

SEQ ID NO: 118271 - DNA, 201 bp, Bos taurus; identical to SEQ ID NO: 37239

SEQ ID NO: 118272 - DNA, 201 bp, Bos taurus; identical to SEQ ID NO: 37240

SEQ ID NO: 118273 - DNA, 201 bp, Bos taurus; identical to SEQ ID NO: 76942

SEQ ID NO: 118274 - DNA, 201 bp, Bos taurus; identical to SEQ ID NO: 37241

SEQ ID NO: 118275 - DNA, 201 bp, Bos taurus; identical to SEQ ID NO: 37242

SEQ ID NO: 118276 - DNA, 201 bp, Bos taurus; identical to SEQ ID NO: 37243

SEQ ID NO: 118277 - DNA, 201 bp, Bos taurus; identical to SEQ ID NO: 76945

SEQ ID NO: 118278 - DNA, 201 bp, Bos taurus
aaaatactctccaatatatgagtaaacgttcaaaccctgtagtaatgaagaaggtaaaaattttaaagatacagaaaaaccatttaagggcccattattakataataaaaaaataaaaacattacaattgccaggaatataaagaaataatgcaatatgatcacgtattgcacagttggaaaaacaagagacaaattgggc

SEQ ID NO: 118279 - DNA, 201 bp, Bos taurus; identical to SEQ ID NO: 37245

SEQ ID NO: 118280 - DNA, 201 bp, Bos taurus; identical to SEQ ID NO: 37246

SEQ ID NO: 118281 - DNA, 201 bp, Bos taurus; identical to SEQ ID NO: 37247

SEQ ID NO: 118282 - DNA, 201 bp, Bos taurus; identical to SEQ ID NO: 76949

SEQ ID NO: 118283 - DNA, 201 bp, Bos taurus; identical to SEQ ID NO: 76950

SEQ ID NO: 118284 - DNA, 201 bp, Bos taurus
agtccttaaccagaaaattgccttgagctgttttctaatattatgattttgtccctctgtttctgcactctcttggtcactttcccttcccagtttttctstgtggctttcagagaaggccaggaatgttctccctgccatctttcattctaagttcttacttatgacatccactcttaaaacccaggcgccatggcctca

SEQ ID NO: 118285 - DNA, 201 bp, Bos taurus
acaggagacatcaaatttaaccccagcctgaggcccaatcacaaaatcaatgcagttaaggtcttgagcttttaataaggaaaagaactaaaaatccaccmaaaaatcttaaatcattcattgatttattcttcattattgatgtttaccttgtatacaactcaggtgctagacacacacacaaacacacaaaacaacaac

SEQ ID NO: 118286 - DNA, 201 bp, Bos taurus; identical to SEQ ID NO: 37252

SEQ ID NO: 118287 - DNA, 201 bp, Bos taurus; identical to SEQ ID NO: 37254

SEQ ID NO: 118288 - DNA, 201 bp, Bos taurus; identical to SEQ ID NO: 37255

SEQ ID NO: 118289 - DNA, 201 bp, Bos taurus; identical to SEQ ID NO: 37256

SEQ ID NO: 118290 - DNA, 201 bp, Bos taurus; identical to SEQ ID NO: 37258

SEQ ID NO: 118291 - DNA, 201 bp, Bos taurus
ccctctacccactcgtcctccatcctggcttcccaagcatcactctgccgtgctcagccctacccgggagacaaggggaaatcgtgacgctgaatagctcmgttctgccaaaggcctcaggccccgtctgcccgccgcctgcctcccggggctgccggtcctctcctgccctgtcaccgccagcccacgccctggctcctg

SEQ ID NO: 118292 - DNA, 201 bp, Bos taurus; identical to SEQ ID NO: 76957

SEQ ID NO: 118293 - DNA, 201 bp, Bos taurus
ttttttttaaagaaagcattctagagggggaaaaaaactggtggaaaatgctagtaaagtctgaacataccaatttcctagctttgcaaccttgaaggccrtgtcttttgtggggaggggtaaatgacatattgaacatgtttgctgtatactgaagccaagaaattcatttagggctcagcacaggagtggggagagcat

SEQ ID NO: 118294 - DNA, 201 bp, Bos taurus
ggggcaggtagatatttgttcacctaggacctggagcagaaatggaggttgacagcaaatgagagcaagagatctctttggggtaattaaaaatggcttamactggattttggtgatagttgcacaactcagtaaatttactaaacagcattgaatagtgtacttaaaatgggtgaattttatcatatatgttatacctca

SEQ ID NO: 118295 - DNA, 201 bp, Bos taurus; identical to SEQ ID NO: 37271

SEQ ID NO: 118296 - DNA, 201 bp, Bos taurus
ggcctgatgccggtctctgggggctgcccctgccccatgcccacctctcccaggccagggttccaaatcctcctcgacatgaggctcagtctcctcatgcytcagcttcccatgcctcagctctgcctctgagtctgcaccaccctgatctcctgacccacagcctagatcctgccttgacccacccctcagcactcacgg

SEQ ID NO: 118297 - DNA, 201 bp, Bos taurus; identical to SEQ ID NO: 76963

SEQ ID NO: 118298 - DNA, 201 bp, Bos taurus; identical to SEQ ID NO: 76965

SEQ ID NO: 118299 - DNA, 201 bp, Bos taurus; identical to SEQ ID NO: 37274

SEQ ID NO: 118300 - DNA, 201 bp, Bos taurus; identical to SEQ ID NO: 76972

SEQ ID NO: 118301 - DNA, 201 bp, Bos taurus; identical to SEQ ID NO: 76973

SEQ ID NO: 118302 - DNA, 201 bp, Bos taurus; identical to SEQ ID NO: 37279

SEQ ID NO: 118303 - DNA, 201 bp, Bos taurus; identical to SEQ ID NO: 37280

SEQ ID NO: 118304 - DNA, 201 bp, Bos taurus
taagcattccttctggcccagtcaaggtagattgtggcaacagcagtagtacctcagagaaagagtgcaggctcccagctcccaccgcttgatcgtggacragctgttctaatctttgggcctccttttcacaatatctaaaatgaggctgagaaaaaaaaaaaaagatcaaaaactaagatcatgggatccagtcccatc

SEQ ID NO: 118305 - DNA, 201 bp, Bos taurus; identical to SEQ ID NO: 37284

SEQ ID NO: 118306 - DNA, 201 bp, Bos taurus; identical to SEQ ID NO: 37288

SEQ ID NO: 118307 - DNA, 201 bp, Bos taurus; identical to SEQ ID NO: 37289

SEQ ID NO: 118308 - DNA, 201 bp, Bos taurus
tttatactcatattttatgaaaaggcccaaggtcagtttgtttcaaagtttgtaagtcttgttatctatttggctgaaccacactgattccatcttgtcarctctatctcaggccagcagtcctatcctctcccctttctatgtgattgaattttagcctactcccaggactgtgcccaagccagataagttcttgtcaac

SEQ ID NO: 118309 - DNA, 201 bp, Bos taurus
gtggtccctgtttccatttctatatctgtctttaggatttttcattatgttataaaatatgatgtttgagagaatatgggctttattctctgatttcaacmtctcaccagaatacatttgctctgcatcttgtcaattacttatttttgtcaaaactctaataatacttcactgagttcttataatagttcaataacaatt

SEQ ID NO: 118310 - DNA, 201 bp, Bos taurus; identical to SEQ ID NO: 76988

SEQ ID NO: 118311 - DNA, 201 bp, Bos taurus; identical to SEQ ID NO: 76989

SEQ ID NO: 118312 - DNA, 201 bp, Bos taurus; identical to SEQ ID NO: 76990

SEQ ID NO: 118313 - DNA, 201 bp, Bos taurus; identical to SEQ ID NO: 76991

SEQ ID NO: 118314 - DNA, 201 bp, Bos taurus; identical to SEQ ID NO: 37295

SEQ ID NO: 118315 - DNA, 201 bp, Bos taurus; identical to SEQ ID NO: 37299

SEQ ID NO: 118316 - DNA, 201 bp, Bos taurus; identical to SEQ ID NO: 37300

SEQ ID NO: 118317 - DNA, 201 bp, Bos taurus; identical to SEQ ID NO: 77000

SEQ ID NO: 118318 - DNA, 201 bp, Bos taurus; identical to SEQ ID NO: 77002

SEQ ID NO: 118319 - DNA, 201 bp, Bos taurus; identical to SEQ ID NO: 37305

SEQ ID NO: 118320 - DNA, 201 bp, Bos taurus
accatgtgaggtcctgtgccattataattcacattttaaattttattaaaaccttaacacacatacactcctgtgaggtaagtactattaatgccctcatyttacagatgagtaaactgaggcacagagtgaataagtgactggcatatggtcccctgagaaggaactgtattttatccgagcctgaccacagcgctcttt

SEQ ID NO: 118321 - DNA, 201 bp, Bos taurus; identical to SEQ ID NO: 37306

SEQ ID NO: 118322 - DNA, 201 bp, Bos taurus
agttgtagaagttatgtaagttaaatcagtgaataagaatgatgtctaaacaatcgtcaaagaccaactctatataatggtcagtaacaagattggaataratttttggcactattttattatttcccactattctaagctccacgaaaataggaactctctctgcctcgttgtcatttaaaaaactgtttattgttgttg

SEQ ID NO: 118323 - DNA, 201 bp, Bos taurus; identical to SEQ ID NO: 37308

SEQ ID NO: 118324 - DNA, 201 bp, Bos taurus
gttttggccaatccaaatttcatgtgaaccagttacttatgactgtgtttaacataagactaaatatacttagagtaaagctctcaggaaatggaatcttrtatctgcaacaaatgtattttgtaagtgtacattttgactccacaatgtctttctctagaaagtcaagtgctccttttgtgtattttatagcttatctca

SEQ ID NO: 118325 - DNA, 201 bp, Bos taurus
ttggtcctagaattagcattagtatatttggccaaatgtttaatgggtttgtgtgtatgtgtgtgcacatgagcacatgtaataattctagaattctgttkggtgctctttagcctttcattccctctgtaccatcctctgtaaaatttgccttctggaatgattctaatgccagtcatttccagcttaatgcaaatttaa

SEQ ID NO: 118326 - DNA, 201 bp, Bos taurus
ctttacaggttaacacaattggagaagatatgattcacacaggacaagtttcctgtcttgctgtgttcctataaagatctgactcaagtgtgaggatccartttaaaaccagcctcttgcctggatcaagattgaagagggggtggaagtggtggccgtgtttaagctttcttaaatataaattacttttatggaacaaat

SEQ ID NO: 118327 - DNA, 201 bp, Bos taurus; identical to SEQ ID NO: 37309

SEQ ID NO: 118328 - DNA, 201 bp, Bos taurus; identical to SEQ ID NO: 77006

SEQ ID NO: 118329 - DNA, 201 bp, Bos taurus
tctttaaaatttagcagtttaatatgcttgtccatttggctccattcctcttcaaacatacctagagctcacactgttggtgggagtccagggcccatttktttttcactttccattggctttctggatcagatgtttgcttttcaaatgctcctttagattttgaaaagtatagtctctcaaagtaagatacatgaaata

SEQ ID NO: 118330 - DNA, 201 bp, Bos taurus; identical to SEQ ID NO: 77008

SEQ ID NO: 118331 - DNA, 201 bp, Bos taurus
ttggcctccaattaaaataaataaatttatattaaaaaaaaagctttattgaaatcctttgagaaattcaggtttgggtgtagaggtaggcataggtcatycatctccttgcatggccctgaaataaatctttctctgctccaaaaaatgaaaacaagttaacttagaaaaagtcaagttgatgtttaagacattatattt

SEQ ID NO: 118332 - DNA, 201 bp, Bos taurus; identical to SEQ ID NO: 37311

SEQ ID NO: 118333 - DNA, 201 bp, Bos taurus; identical to SEQ ID NO: 37312

SEQ ID NO: 118334 - DNA, 201 bp, Bos taurus
cagcatgcgtctcagcctaagctgaacagccactcaggcccctgatacttcataatgtagctccacactaaggaaagggatgctgaggccaagggcagtgyttagttgtgagggagagagtcagtgcagacctgggacggcatcggatgtaggcaggggcagccatcactagcacttacggaggcagcacctctgaagcag

SEQ ID NO: 118335 - DNA, 201 bp, Bos taurus
aaaaatcttttgtagtttgtgagttcttacaacttcacagcttaactcttctctctgatcccatgtaggcactttatttttcacttgtttctccagtttgmtgagcttctgacccatttcaccaatacacaaggaaggagattcacttagctcccaggaacaaagtcaactctctgtgccaaacactgtacaataggttcc

SEQ ID NO: 118336 - DNA, 201 bp, Bos taurus; identical to SEQ ID NO: 37314

SEQ ID NO: 118337 - DNA, 201 bp, Bos taurus
tctggttctcaatgacaaagaatggcctctcaactatcattttggtaacatgggaaacttagaagctacagagtatccacaaccaggatttaatttccaayattttatttcagattaaacatcacaaagaacgggattaccttgcagaacactgaagaagtaggctgggaagtaagaatcaaacaatgggaaatttgaatc

SEQ ID NO: 118338 - DNA, 201 bp, Bos taurus; identical to SEQ ID NO: 37317

SEQ ID NO: 118339 - DNA, 201 bp, Bos taurus; identical to SEQ ID NO: 37318

SEQ ID NO: 118340 - DNA, 201 bp, Bos taurus; identical to SEQ ID NO: 37319

SEQ ID NO: 118341 - DNA, 201 bp, Bos taurus; identical to SEQ ID NO: 37320

SEQ ID NO: 118342 - DNA, 201 bp, Bos taurus
tatctatactaatttcaatgaaaacatttgagaattaacatgatcttaaagagaaaaatagtctttgagactacagtagaacacacacagaccattgtttycatgggcactcctgttataacctctccccaaagaaagacatgttaagttcctatcccgtctactgagagaaagcaatagattaagtgctaactcaaattt

SEQ ID NO: 118343 - DNA, 201 bp, Bos taurus
gggattgaactgcatctcttttgtctcctgcattggcaggcaggttctttactgtgagtaccacctgggaagcccacaaaacagagtacaaatctcaaacrtttccgggtgccattgtgcctttgatagagcaaaatcaagtctccaaaatataagaaaggcctggaaggtattaaggatcaaaattagcatcttttttgt

SEQ ID NO: 118344 - DNA, 201 bp, Bos taurus
aggcttgtgttttggcctctgtttagctgtgttaggcctatgagtgacagcttccctgcttgaagcacacagaaagcacagccttcctcattcactgacargactgtggccttttcacacgttccttccacagcagtgtttgtccccaaacactggaactccacacaatggcattcctacttcaacacccccaccaacagc

SEQ ID NO: 118345 - DNA, 201 bp, Bos taurus; identical to SEQ ID NO: 37325

SEQ ID NO: 118346 - DNA, 201 bp, Bos taurus
gcgcaatggcaatgcgaggctctatatgagtttcactccagatgaacttaatctctggatgaaaccacccagacccaggggctgcctggcccagggttccrttcttcccacactgggagaaacaacataattagaaatgcaatgagatgaggtttctgttcctctctccagttacttcctccccatcatttggcctgggac

SEQ ID NO: 118347 - DNA, 201 bp, Bos taurus
ctttgtaatcagggttcatggaacggctgcatagtgatttcatccctggccaaagatgccataaaaaagagaaatattcagtgatcaccatttcacatcgmtgtaaaagactgagaattggggcccagaaagctcggcttccagcaacattctgctttgacaggaccttaaaatgccttctggagtcaagacagggagaaa

SEQ ID NO: 118348 - DNA, 201 bp, Bos taurus; identical to SEQ ID NO: 37329

SEQ ID NO: 118349 - DNA, 201 bp, Bos taurus
agggtctcctgcattgcagtcagattctttactgtctgagccaccagggaagccccatagactttttgtattgaacactaaaaaaaaagaaaaagaatttytaattgttagattattccaagttataatattggacctactcttttttaggatttctttttggttggaaataattcacagaatctgacatgtatatatcat

SEQ ID NO: 118350 - DNA, 201 bp, Bos taurus
cgaactcgaaatagcctattaaatgctgtagaggtggcgcacaaggtaaaatgatgtgaagaatgagatcaaaagttgaatcaagcaattagaaaaaagtrtacaagataaaaatagagccataattccacgggggaaccagatgtgcttttgtcaggggggaaatctatatgcatgtggttctgtcatgactaaactggc

SEQ ID NO: 118351 - DNA, 201 bp, Bos taurus; identical to SEQ ID NO: 77027

SEQ ID NO: 118352 - DNA, 201 bp, Bos taurus; identical to SEQ ID NO: 77028

SEQ ID NO: 118353 - DNA, 201 bp, Bos taurus
accttcctaacctagagatgctgggtccatgcagtggcctcttagacatctttctgctgcacacacactattagttttgattggaggcttttatttatgaycaaaaggccatttctcaggtcatgtaattatgctaaaagccaagaccgtctggcgactacaacctctgagagcatgtcaaacaccatcatgatttcaagg

SEQ ID NO: 118354 - DNA, 201 bp, Bos taurus; identical to SEQ ID NO: 37331

SEQ ID NO: 118355 - DNA, 201 bp, Bos taurus; identical to SEQ ID NO: 37333

SEQ ID NO: 118356 - DNA, 201 bp, Bos taurus; identical to SEQ ID NO: 37334

SEQ ID NO: 118357 - DNA, 201 bp, Bos taurus; identical to SEQ ID NO: 37335

SEQ ID NO: 118358 - DNA, 201 bp, Bos taurus; identical to SEQ ID NO: 37336

SEQ ID NO: 118359 - DNA, 201 bp, Bos taurus; identical to SEQ ID NO: 37337

SEQ ID NO: 118360 - DNA, 201 bp, Bos taurus
ggtgatgagtgctagagctgagaggggccaaagcccaacttcggagcctcagcaacccacaatacatcagtccagggtcaacaagccccgctgcactccarggccagaccttcctccatctgaatgcacagtcctcgccgtgtcaggccacctccccacaggcaaacaggccagggtcagggctcttcggccaccttgtca

SEQ ID NO: 118361 - DNA, 201 bp, Bos taurus; identical to SEQ ID NO: 77039

SEQ ID NO: 118362 - DNA, 201 bp, Bos taurus; identical to SEQ ID NO: 37339

SEQ ID NO: 118363 - DNA, 201 bp, Bos taurus
atcatcccaaaccaaaacaagttccagcattgagcgcaatacatggcacacggtgcaggcacttttccacaagtgtttgctagtgacaatgggtgaaggayagggttaattatctcttgccttgtcttgcgacagatggcgtgtcatgtacgcagagtcagatatttatgtctccaggaatcctttcacaagagaggtgga

SEQ ID NO: 118364 - DNA, 201 bp, Bos taurus
cgcagggctatgtctatgtccatcctctctattgagtgtagtccaaagagactgaaacgatctgacgattatgcagaatactgctgggacttgatccaccrtatgatatcattttgtcagtgatgaaagtgaaagtgttagttgttcagtcgtgtccaacacttttgtgactccatggactgtagcctgccaggctcctct

SEQ ID NO: 118365 - DNA, 201 bp, Bos taurus
aggagaaaattaaatttgttgacaacatttaaaaactaggaacttcagataaacattctaaatttttgtcttcctttgaaaattttaagttaggacctatrtggtgacagacgattgagactgagtaatgactgttctcttcaggtaggaaattacatactttgtagttgaccattttctcttctgttacctctcagccag

SEQ ID NO: 118366 - DNA, 201 bp, Bos taurus
aggaagtcatttattaagggtctgctaatatctcccagggctaccctaagaagtcaggttcccttatggcacaggaataatgtggttgaatgtcaataccmctctaccctcttctcttctcttctcctcaaagtcatgtcagtcatcatatgaggcaggaaggctcacaaacattaaatattccctagcaattagatttaa

SEQ ID NO: 118367 - DNA, 201 bp, Bos taurus
atgttgagttgtgtgagttctttgtatattttgggtattaactccttatttgatacctcatttgcaagtatctcatcctgttcagtagacggcctttcagrttgttgatcctttccttctttgtgcacaagctttttattttgtttcgtgctgtttgtttgggcttcccaggtggccaaagtggtgaagacccacctgcca

SEQ ID NO: 118368 - DNA, 201 bp, Bos taurus
tcagaggctccaggatggctttcctggccttagcctgccaggatggctcctccttggacaagttctcccttctccccatcaacctggatggttcttttccyttcacatggggcctgagaaagttgaccttcttctcttcggtccctttttgctctcaattcctgctgagcctccaaggctgtgagcagggtttggggggag

SEQ ID NO: 118369 - DNA, 201 bp, Bos taurus; identical to SEQ ID NO: 37343

SEQ ID NO: 118370 - DNA, 201 bp, Bos taurus; identical to SEQ ID NO: 77046

SEQ ID NO: 118371 - DNA, 201 bp, Bos taurus
gactcgtgaacccttggctattccttagatgataatgatcatggccacaatagcaaacactgatataaggccttaccacgggccaggcgctgttctaagartgttacgtgtcatgatttcatttaatccttttgatagccccataggggtagaggctgctcctggccccattttccagatgaggacaattaagcacagaaa

SEQ ID NO: 118372 - DNA, 201 bp, Bos taurus; identical to SEQ ID NO: 37348

SEQ ID NO: 118373 - DNA, 201 bp, Bos taurus
catcccatctgacctgtgtcccttctaaaagaggaaatttggacacagagagagaccagggatgcaggcatgcagaggaaagtccacgtgaggtggcagcraggaggggccatgtgcaagccaaggagagaggtctcaggagaaactaagacttcccacaccttgatcttggacttctagttcccagaagtgtgagaaaat

SEQ ID NO: 118374 - DNA, 201 bp, Bos taurus
ttcagcctggcctttcctccccgtgtgaccccaggcagttcagttttgtgggctggggctcctgtttcctatcgtgaaattatcttccagtattcctgtcracttggccggagttcaaggattctgtgatcatagggccgcagagtctgagacctggaaggaacctgcagttccctttgttggaggtgctgagagtccctc

SEQ ID NO: 118375 - DNA, 201 bp, Bos taurus
ttcacaaatctgagggtaaagactgcacggcaatgaggggcttttaaaaagggaaacttcacagtttgtcaggggtcctgagggcaggtgaggatgaaggytctcaaaagcaaaaccttcttttggcaaagatgactgtcactgcccagcaagatggaaggtgatggagaacggactcttctttattcatttttattcaaa

SEQ ID NO: 118376 - DNA, 201 bp, Bos taurus; identical to SEQ ID NO: 37349

SEQ ID NO: 118377 - DNA, 201 bp, Bos taurus; identical to SEQ ID NO: 37350

SEQ ID NO: 118378 - DNA, 201 bp, Bos taurus; identical to SEQ ID NO: 77051

SEQ ID NO: 118379 - DNA, 201 bp, Bos taurus
gttccagttttttggccaaaagacctgtgggatcttagcttccagaccagggattgaacccacaccccttacattgggagatagagtctgttaaccactasactactagggaaggccactgcctcattcttctgatcacctttctagttccagcactgtttcagctcagtaactgatacaccgaggtctgtgcagtaaccc

SEQ ID NO: 118380 - DNA, 201 bp, Bos taurus; identical to SEQ ID NO: 37353

SEQ ID NO: 118381 - DNA, 201 bp, Bos taurus; identical to SEQ ID NO: 77057

SEQ ID NO: 118382 - DNA, 201 bp, Bos taurus; identical to SEQ ID NO: 37356

SEQ ID NO: 118383 - DNA, 201 bp, Bos taurus; identical to SEQ ID NO: 77059

SEQ ID NO: 118384 - DNA, 201 bp, Bos taurus
aggatttagttgcagtgtgagagaactttgttgcatcttgtggggtctttttgctggagctgggctctctggttacgacacgtgggctccagcctgggccygtgtagtagttgtggcatgcttagtttccccgaggcatgtgagatcttagttccctggtcagggattgaacatgcatctgttgcattgcaaggtggattc

SEQ ID NO: 118385 - DNA, 201 bp, Bos taurus; identical to SEQ ID NO: 77061

SEQ ID NO: 118386 - DNA, 201 bp, Bos taurus; identical to SEQ ID NO: 77063

SEQ ID NO: 118387 - DNA, 201 bp, Bos taurus; identical to SEQ ID NO: 77064

SEQ ID NO: 118388 - DNA, 201 bp, Bos taurus; identical to SEQ ID NO: 77065

SEQ ID NO: 118389 - DNA, 201 bp, Bos taurus
gtagtataatccaattgcagaggttctcccccaagaagtgaggattctgaaccccacgttaggctccccattccaggtatcttgccctagaaagatgagcraccagaatgtctgactttggaggccagtgaggtttgagtacaggtgagacagagatctttagggaaaatagacccctctcttaaaggacatgctcaaaat

SEQ ID NO: 118390 - DNA, 201 bp, Bos taurus; identical to SEQ ID NO: 77066

SEQ ID NO: 118391 - DNA, 201 bp, Bos taurus; identical to SEQ ID NO: 77067

SEQ ID NO: 118392 - DNA, 201 bp, Bos taurus; identical to SEQ ID NO: 77068

SEQ ID NO: 118393 - DNA, 201 bp, Bos taurus; identical to SEQ ID NO: 37358

SEQ ID NO: 118394 - DNA, 201 bp, Bos taurus
agagtcaaaggtatttacttatttctacagccccattcattgtactgtaattatctagtgaaacatgaagccaaatctagaggtttaaacatatcaagaayaaaattctaacttttgaagagtactgtctcatctatttgagtttaagcaactcaaatatgattcataattctaatcaagaaactaacattttggtaaatt

SEQ ID NO: 118395 - DNA, 201 bp, Bos taurus; identical to SEQ ID NO: 77076

SEQ ID NO: 118396 - DNA, 201 bp, Bos taurus; identical to SEQ ID NO: 77080

SEQ ID NO: 118397 - DNA, 201 bp, Bos taurus; identical to SEQ ID NO: 37370

SEQ ID NO: 118398 - DNA, 201 bp, Bos taurus; identical to SEQ ID NO: 37371

SEQ ID NO: 118399 - DNA, 201 bp, Bos taurus; identical to SEQ ID NO: 37373

SEQ ID NO: 118400 - DNA, 201 bp, Bos taurus; identical to SEQ ID NO: 37374

SEQ ID NO: 118401 - DNA, 201 bp, Bos taurus
aggccaatcgtgagttcacacagctttggtgggaacagcagcacatctcagtgatgtgaggagcccaaggagtccttgtccagatgggattagtaatatcwctgtaatgcaaatatggcccagctattgtaggaggctgatttatatctggaaatgactttcctaactccatgagagaagtgaaacatttatggtagtagt

SEQ ID NO: 118402 - DNA, 201 bp, Bos taurus; identical to SEQ ID NO: 37375

SEQ ID NO: 118403 - DNA, 201 bp, Bos taurus
cctttcttctttagcagggcatgtgactgtaataaagtttataattcccagcctcccttgcagataagtaaattcatataaataagttttaggtaatgtgmtatcaagggaggtgaaatgcaatttaagcaggtgttattatgacataaatttcattgcctttcttttttttttctgggaaaaaaaactgactgatagctg

SEQ ID NO: 118404 - DNA, 201 bp, Bos taurus; identical to SEQ ID NO: 37376

SEQ ID NO: 118405 - DNA, 201 bp, Bos taurus
tctctctccaagaattggtaattctgatacattttgcaactcaaaagagatgttctttctttgtaattcacaaaacaaattaaactcatctttccaagcargtaaccatcctgatttgaagcaattccatgctcatggttcttttcataaacttatttgaaaatgcttttcaaaggggcattagtgttttgcgtttacatc

SEQ ID NO: 118406 - DNA, 201 bp, Bos taurus
taaatggacctgaaatgaaaattctgtcttatttaagaatactattcacaagtacaaagatgtggccttgttttccattgcctggcccttgttctctttcygactcttcattcaattatgaagagcacattccaagtagcctacatataaaaggaatgtttttctgattaaatatcgaacattaagatggtcaggcctatg

SEQ ID NO: 118407 - DNA, 201 bp, Bos taurus
aaccgttcctggtaactctactcaacactgctcactttgttgacagcccatggtgttaattatacagaatgtgttaacacatttatctcttcatcagaggktctctgctgggctcctgtgcatattgccttattaacacatctgttaaattcctgtaagtcagggattttgccttatgtttcctctcggtctcccatggca

SEQ ID NO: 118408 - DNA, 201 bp, Bos taurus
attttcagagacaggttgaggcaatgggtaaattcgaatagagattctatttctcccagaccctatgctcatttcacctcatctggcttcaatcccagctwctcgttcttgcttttatttcccttctgtttctttccttgagttgcatttctgatgccaggtgggagcaacagctgaacacggtggaggcgtaagatacgg

SEQ ID NO: 118409 - DNA, 201 bp, Bos taurus; identical to SEQ ID NO: 37378

SEQ ID NO: 118410 - DNA, 201 bp, Bos taurus
cctgagaggaattcaggatgaaagccgggatgaggtgctctgttctttggcaaaactaccatttgatagatatgtatctcgggataaattttaatgaacayagatccttgtatcttcccatacagaaagcactaaaatcattcactgagatatctgttccttggaccagcattaccatgatgtatgcttggctgttcatat

SEQ ID NO: 118411 - DNA, 201 bp, Bos taurus; identical to SEQ ID NO: 37379

SEQ ID NO: 118412 - DNA, 201 bp, Bos taurus; identical to SEQ ID NO: 37380

SEQ ID NO: 118413 - DNA, 201 bp, Bos taurus
tggcagcaatggctagacacatgagggcctcacgcagatgtggtcagattgaaaaggatttgccctgtggctcaatctggactgagacccagcagaaactygctggccctaactctgccagaaactggcagggtattctcctgcctaaacttcaaactcttcattttcaaaataggtaatattggcatagtggatttccaa

SEQ ID NO: 118414 - DNA, 201 bp, Bos taurus
tgagagacagagagaagatgaagggggtgggaattattatttcccaagcttatccaactagttgagaggttcagctgtttcttctttccgctttccagagygccctgcaataggctcctccttgccacatccactcaggagacaaagaaggctgcctctcagcctaattaaaagtcctaaggcagcagaagagaagagggg

SEQ ID NO: 118415 - DNA, 201 bp, Bos taurus; identical to SEQ ID NO: 37383

SEQ ID NO: 118416 - DNA, 201 bp, Bos taurus; identical to SEQ ID NO: 37385

SEQ ID NO: 118417 - DNA, 201 bp, Bos taurus
caggagcagtgggtggccgggaaggactgagaggccagacggtaacctgtccgggtaaagtgagaacagcttcacgtggcctctggggctgtgtctgattyactcttccttctgcctattgatttccagtctcctctccttgatgctattgctcctctacgggtattgctgggtttgtccaccatcattaattcattaact

SEQ ID NO: 118418 - DNA, 201 bp, Bos taurus; identical to SEQ ID NO: 37387

SEQ ID NO: 118419 - DNA, 201 bp, Bos taurus; identical to SEQ ID NO: 37388

SEQ ID NO: 118420 - DNA, 201 bp, Bos taurus; identical to SEQ ID NO: 37389

SEQ ID NO: 118421 - DNA, 201 bp, Bos taurus
ttagaattctttaatttgaatttgactggctcataactttgtatttattgctaatagatttagtttgtataccatctggaacaaaatcaaaacagacgtcmctttctcagattttttaagggatgattccctaatgtgtatatatgtgttggggatattagtttaattttaaagttatttttacctcaagcttagtattcc

SEQ ID NO: 118422 - DNA, 201 bp, Bos taurus
agaaagcccaagaagcagggcagactgcacactgaaaacatggaccacaggcagcttgccccaaagcaggcctcggagcagtctgacacttacctcagggyccttcatattgaaatcaggttccaagtggttgtcagctaaaccaccaactcatgtggcattaatgattcctataagttggggtcacagctcattaattaa

SEQ ID NO: 118423 - DNA, 201 bp, Bos taurus; identical to SEQ ID NO: 77090

SEQ ID NO: 118424 - DNA, 201 bp, Bos taurus
tcttttgtgggtcttatatttctacaagctttagcaactagatacacagctaatcatttgatgattacaaaggaggtgtctgcggagacagcagaggatcrgcttggggtacccagttggcctggtctacagggaggtggtcagatgaggtctgtttgaggaagtgatgcttgaagtatgctctgcatcagaggttggcaa

SEQ ID NO: 118425 - DNA, 201 bp, Bos taurus; identical to SEQ ID NO: 77092

SEQ ID NO: 118426 - DNA, 201 bp, Bos taurus
ttccagtgaggcctcttcaaaggggtgggaggcgcgagtgggtgggctggggaacagacgtggtcatttggctgcattgcttctcggggttggcatcagtrctcacggggcaggccaaaggatgccttgtagataaaagggaggcggaccatgagtctccagagaagggactctcctcaggtggggctgaggacccaagga

SEQ ID NO: 118427 - DNA, 201 bp, Bos taurus; identical to SEQ ID NO: 77113

SEQ ID NO: 118428 - DNA, 201 bp, Bos taurus; identical to SEQ ID NO: 77115

SEQ ID NO: 118429 - DNA, 201 bp, Bos taurus; identical to SEQ ID NO: 77116

SEQ ID NO: 118430 - DNA, 201 bp, Bos taurus; identical to SEQ ID NO: 37417

SEQ ID NO: 118431 - DNA, 201 bp, Bos taurus; identical to SEQ ID NO: 37421

SEQ ID NO: 118432 - DNA, 201 bp, Bos taurus; identical to SEQ ID NO: 77119

SEQ ID NO: 118433 - DNA, 201 bp, Bos taurus; identical to SEQ ID NO: 77121

SEQ ID NO: 118434 - DNA, 201 bp, Bos taurus; identical to SEQ ID NO: 77122

SEQ ID NO: 118435 - DNA, 201 bp, Bos taurus
taattttatggatcctacactctgagaaggcaggagccaaatctgtttttattagccactgaagacccaacaaatatccatgtgcctgtttcattatttcrgctcaaaaatatttactgatgaatgaaggacagaggaataatggaacacatttattatgaaattgctttgtatgtagatgtagtcacagatttaaaaaaa

SEQ ID NO: 118436 - DNA, 201 bp, Bos taurus
ccggccaaactgggttgtaaaatggaggaatattgggagttgatcaccccttttcctgaatcaacttgagctggagaaaggggatggatgaaggtcaaagrcaaagcaaggccacaaaccaagggccccagggcattgtgcggctcctcagtgccgggcagggggatggctgggtgcagggatgtatcctttgtccctgtt

SEQ ID NO: 118437 - DNA, 201 bp, Bos taurus; identical to SEQ ID NO: 37423

SEQ ID NO: 118438 - DNA, 201 bp, Bos taurus; identical to SEQ ID NO: 37424

SEQ ID NO: 118439 - DNA, 201 bp, Bos taurus; identical to SEQ ID NO: 37425

SEQ ID NO: 118440 - DNA, 201 bp, Bos taurus; identical to SEQ ID NO: 37427

SEQ ID NO: 118441 - DNA, 201 bp, Bos taurus; identical to SEQ ID NO: 37428

SEQ ID NO: 118442 - DNA, 201 bp, Bos taurus; identical to SEQ ID NO: 37429

SEQ ID NO: 118443 - DNA, 201 bp, Bos taurus; identical to SEQ ID NO: 37430

SEQ ID NO: 118444 - DNA, 201 bp, Bos taurus; identical to SEQ ID NO: 37431

SEQ ID NO: 118445 - DNA, 201 bp, Bos taurus; identical to SEQ ID NO: 37432

SEQ ID NO: 118446 - DNA, 201 bp, Bos taurus; identical to SEQ ID NO: 37433

SEQ ID NO: 118447 - DNA, 201 bp, Bos taurus; identical to SEQ ID NO: 37434

SEQ ID NO: 118448 - DNA, 201 bp, Bos taurus; identical to SEQ ID NO: 37435

SEQ ID NO: 118449 - DNA, 201 bp, Bos taurus; identical to SEQ ID NO: 37436

SEQ ID NO: 118450 - DNA, 201 bp, Bos taurus; identical to SEQ ID NO: 37437

SEQ ID NO: 118451 - DNA, 201 bp, Bos taurus
ctccttctcgggtgtgactcacaggccccgagcctcaggcagagacctctccctacaagagataagccctctcggggagagagctagaaggggattgatcygggggaggtggtcagtggccactctctttcccttaccttgctggtcttttttttttttctcccttcttgtttccagttccctctgcagctgccctgaact

SEQ ID NO: 118452 - DNA, 201 bp, Bos taurus; identical to SEQ ID NO: 37439

SEQ ID NO: 118453 - DNA, 201 bp, Bos taurus; identical to SEQ ID NO: 77139

SEQ ID NO: 118454 - DNA, 201 bp, Bos taurus; identical to SEQ ID NO: 37440

SEQ ID NO: 118455 - DNA, 201 bp, Bos taurus; identical to SEQ ID NO: 77143

SEQ ID NO: 118456 - DNA, 201 bp, Bos taurus; identical to SEQ ID NO: 77148

SEQ ID NO: 118457 - DNA, 201 bp, Bos taurus; identical to SEQ ID NO: 37447

SEQ ID NO: 118458 - DNA, 201 bp, Bos taurus
gtagccatatcctccagagcaaatgagaggcaacatatgttttttatttatccacataatttctcaaggctctgaaagctggtttcaacacaaaccaagcrtgaggcatctcagctgggcatccctgggcatagggaccacctatgtctatggtggtttcagataactcagctaaggctgaggatggcttttttctcaaag

SEQ ID NO: 118459 - DNA, 201 bp, Bos taurus; identical to SEQ ID NO: 37449

SEQ ID NO: 118460 - DNA, 201 bp, Bos taurus; identical to SEQ ID NO: 37453

SEQ ID NO: 118461 - DNA, 201 bp, Bos taurus; identical to SEQ ID NO: 37454

SEQ ID NO: 118462 - DNA, 201 bp, Bos taurus; identical to SEQ ID NO: 37455

SEQ ID NO: 118463 - DNA, 201 bp, Bos taurus; identical to SEQ ID NO: 37457

SEQ ID NO: 118464 - DNA, 201 bp, Bos taurus; identical to SEQ ID NO: 37458

SEQ ID NO: 118465 - DNA, 201 bp, Bos taurus; identical to SEQ ID NO: 37459

SEQ ID NO: 118466 - DNA, 201 bp, Bos taurus; identical to SEQ ID NO: 37460

SEQ ID NO: 118467 - DNA, 201 bp, Bos taurus; identical to SEQ ID NO: 37461

SEQ ID NO: 118468 - DNA, 201 bp, Bos taurus; identical to SEQ ID NO: 37532

SEQ ID NO: 118469 - DNA, 201 bp, Bos taurus; identical to SEQ ID NO: 77216

SEQ ID NO: 118470 - DNA, 201 bp, Bos taurus; identical to SEQ ID NO: 37538

SEQ ID NO: 118471 - DNA, 201 bp, Bos taurus; identical to SEQ ID NO: 37539

SEQ ID NO: 118472 - DNA, 201 bp, Bos taurus; identical to SEQ ID NO: 37543

SEQ ID NO: 118473 - DNA, 201 bp, Bos taurus; identical to SEQ ID NO: 37544

SEQ ID NO: 118474 - DNA, 201 bp, Bos taurus; identical to SEQ ID NO: 37545

SEQ ID NO: 118475 - DNA, 201 bp, Bos taurus; identical to SEQ ID NO: 77225

SEQ ID NO: 118476 - DNA, 201 bp, Bos taurus; identical to SEQ ID NO: 77226

SEQ ID NO: 118477 - DNA, 201 bp, Bos taurus; identical to SEQ ID NO: 37546

SEQ ID NO: 118478 - DNA, 201 bp, Bos taurus; identical to SEQ ID NO: 37548

SEQ ID NO: 118479 - DNA, 201 bp, Bos taurus; identical to SEQ ID NO: 77232

SEQ ID NO: 118480 - DNA, 201 bp, Bos taurus
cagaagcagataaatatccccaaatatcttgtcctcttaacagagaaaaaaccaaatcctagttttgtatcaacttacttttaatattaaaatgtatttaytcaaatttattcttaattaatctgtcctgaccatacactgtttttcccattatttcttttccacaaaccttctataacttccttttttactttcagattc

SEQ ID NO: 118481 - DNA, 201 bp, Bos taurus; identical to SEQ ID NO: 77235

SEQ ID NO: 118482 - DNA, 201 bp, Bos taurus; identical to SEQ ID NO: 37550

SEQ ID NO: 118483 - DNA, 201 bp, Bos taurus; identical to SEQ ID NO: 37554

SEQ ID NO: 118484 - DNA, 201 bp, Bos taurus
atggcctgctcaccctacttggcctccgacacacaggggcaggtagcatcatctcagctctggggctccgtgcaggctaccttcttttattaacctattgkatggccaagtgctctgctcctgtgctatactccacttgagttcttaactcctgtgctacgctccctctctagtgcaaagggttctgaacttcctggatac

SEQ ID NO: 118485 - DNA, 201 bp, Bos taurus
tgtcaccatctttcactatcatatagtttgatttgtgcacttctcattttctcttcatttctcagaagatgtcaattagggtcctttctaccgaagaaacyttgttgtttggccaggcttgttacttaaatacgttttgctcccttgtgtgtctgttagttgcttagttgtgtccagctctttgtgactccatgaactgta

SEQ ID NO: 118486 - DNA, 201 bp, Bos taurus
gaggagtctgttgagccacagtccaaggaggtcacaaaagagtcgaacatgactgagcaactgagcacacatataagatatagatagagacgagcacacgmgttctcaccaaagacactatcttgtaaatcacggggatagtttttaacactgacaattcttgatcatcgaaaagcagttttcacaaaggcccccttcctg

SEQ ID NO: 118487 - DNA, 201 bp, Bos taurus
ctgtgtctcctgcactgcagccagattctttaccactgagctgagggggaagccatcaattcatcccttaaatatttcagacaactatcttcagtttttaratattcttatgctgtttatgtgtctggttcatcaagttttatattacctctactttcttatggctaactattaacaggcatttattttttacaaagtgcg

SEQ ID NO: 118488 - DNA, 201 bp, Bos taurus
tccagtaatcagtacaaatcttttcaaaattctgagcgggaaatagttttcttcttaaatttgacatgcaaaattatcacctacgaactatgtgtgtgtgygcatgcccagttgctcagttgtgtctaactctttgagcccccatgaacagcagcccaccagcctcctctgtccatgggatttccaggcaagaatactgga

SEQ ID NO: 118489 - DNA, 201 bp, Bos taurus; identical to SEQ ID NO: 37557

SEQ ID NO: 118490 - DNA, 201 bp, Bos taurus; identical to SEQ ID NO: 37558

SEQ ID NO: 118491 - DNA, 201 bp, Bos taurus; identical to SEQ ID NO: 37559

SEQ ID NO: 118492 - DNA, 201 bp, Bos taurus
cagagcttccagtgtagagggaagtccacgcaaaactcagtctgagacatcagatgctaactgacaaccttcagtcctcatttgaacctcctgccaggatygggccctgggtttcagaaaccagtgctcgctccctttccagcagcctctggggcacccggccaggtgttctccatcaaggcaggatgcacccacctgctt

SEQ ID NO: 118493 - DNA, 201 bp, Bos taurus; identical to SEQ ID NO: 37561

SEQ ID NO: 118494 - DNA, 201 bp, Bos taurus; identical to SEQ ID NO: 37562

SEQ ID NO: 118495 - DNA, 201 bp, Bos taurus; identical to SEQ ID NO: 37563

SEQ ID NO: 118496 - DNA, 201 bp, Bos taurus; identical to SEQ ID NO: 37564

SEQ ID NO: 118497 - DNA, 201 bp, Bos taurus; identical to SEQ ID NO: 37565

SEQ ID NO: 118498 - DNA, 201 bp, Bos taurus
aaaggagattcctgaaagaattcaggaggctaggatggtgaagaggggatttgttaggagggcagagatgaagcgtgaagctagaaagtaggcaaaaggaractggcagtaacactttttccccaagagtgatggactgggtcaagattcagggaggttttgctggcagtgggtcagcaaaattaaggaaaggaataaaag

SEQ ID NO: 118499 - DNA, 201 bp, Bos taurus
ggggcatgaaatatttattgagtgcccactttcatcaggcattttttttttttttgcatgctattttattagatcattaaacttaacatactttaagtaaragcataaatttctttggcttccaaacccacagtctgtaccactgtatatcttacatcggaaaataaaatgcactattttaaaacttatacccaatacgat

SEQ ID NO: 118500 - DNA, 201 bp, Bos taurus; identical to SEQ ID NO: 37576

SEQ ID NO: 118501 - DNA, 201 bp, Bos taurus
cttgcctcaaaatcttcctcatggcttccccatcactgaaaaaggaagtgtaaagtcttctgcattccaagaagaaactccaagcataaaggcctggagayagcagcatatttgctctgttcaagaaacaggaaggagacccaagtggcgaggcaaaatcagacataggacagggtaggccgatggggaagggagatggga

SEQ ID NO: 118502 - DNA, 201 bp, Bos taurus; identical to SEQ ID NO: 37578

SEQ ID NO: 118503 - DNA, 201 bp, Bos taurus; identical to SEQ ID NO: 37579

SEQ ID NO: 118504 - DNA, 201 bp, Bos taurus
tccacgggattctccaggcaagaatactggagtgggttgccatttccttctccagctacacatataggttactgaatattgagtagcgttccttgtgctayacagtagggccttgttagttattttatatatagtagtgtgtatatgtcaatcccaaactcccgaaggcttgatttaaaagctttagtactttggtcctgg

SEQ ID NO: 118505 - DNA, 201 bp, Bos taurus
acactatggggaaggctgagcaaactgaatccttgaacatctttggatctttagaagatcaaataaaaaacagctgcaattttatttgttgcatttccaamaaaacacagtgacttgtatcatgatgtgaaaacaaatatgctctgtattaatgtaaataagaatattttttctaatttgatggaagaaggttgacatgaa

SEQ ID NO: 118506 - DNA, 201 bp, Bos taurus
aacattatgcagccaaacaaaagaataaaaataggtataatttataatctcttagactttttttaaagtttaaaaatcacagtgcagattaactgatgctrtatttgtatagatgggtatgggaagaattggatatagggcacttcttgtgatatttgtctcttaaaacctgtgaatctattactattaaaaaaacaaagt

SEQ ID NO: 118507 - DNA, 201 bp, Bos taurus
agatacatccctttggaagttgtagttgcaaaagtcatttcaagaacagggtatagttttgtgatagcttgaaggcaagagagcacatggcctattctggraactataggaatagaatggctctgtcataggattgaagtggtaaaagaagacatgggagatgaagtctgaggccgggtggatgaactatgacatcctaag

SEQ ID NO: 118508 - DNA, 201 bp, Bos taurus
ccacactatttgattccctttcctggcctgaagctgccccttattttcttgggctgccttgcacaactgagacccttctaggatcccaaacaggaggcagraaaactacagttgtctttggcatcctgctcaatctgccaaacctcttctctgcctccaagactttttgccctggagttcagtcaggcacgggtcactcgg

SEQ ID NO: 118509 - DNA, 201 bp, Bos taurus
ctctccaagccttgtagtcagtaagcagactcctcttaggccaaaggatagcaaatgcaatgaacagcttgttatatcaagtgctctcaattttccttccrcaaaaccaaaggggccacaaaaatttcctccttttgcaacaaaatgtcagtctccattatcagctggtactagctgggggccactcttgtttcctattgc

SEQ ID NO: 118510 - DNA, 201 bp, Bos taurus
aaaacatttccatgctatagcttatgactcttgggctaactcactgaatggccacactggcagctttgagcctgtttttgagtataaaaggcaaaaagacrataacttgccctctgtgtggtatctcattttgacttcgcagtcaatttgggggcctattaaataatattgtcaaaaaagcagtgtgaaaaggactgacac

SEQ ID NO: 118511 - DNA, 201 bp, Bos taurus
agatttctgggacattcaggggccattctaccctgttagacaagatctgtaaagagctaagttctagagctactttcatcaacttgtctctgggatgcctyaggccagataatactactggttccccttcaatgagcacagaatacgtattcaggcagagttttaagcactttatgaatctcaactcatttaatcttcatg

SEQ ID NO: 118512 - DNA, 201 bp, Bos taurus
atatagggataacactatttttcactgcttggaaaccctacccaagaatataagcattgtgaaaaaagacatttgatatgatgatagcaagcatttgctayagtaatatagacactattttcatcaaagtagtccgtaagctgttcgtcagaaggagaacacagattatgtactcttaatacagaccacatgcaagtagaa

SEQ ID NO: 118513 - DNA, 201 bp, Bos taurus
gtttttgaccagagccatggttcatccaacccagtaaattagcatgacggccttatgatgaatctggtggttgcccactatgttgccacttttcaacttcrtgttctttacataagttagaggcctcaagacccctggtgctctgtacaactgtttagggtgtgccctgcataagagagcctgtccggcaggcttagatct

SEQ ID NO: 118514 - DNA, 201 bp, Bos taurus
tgaaggccatgactcaccaaggatggtaggagctaccagatgctggaagaatcaagaaagaatgactccctagagtcttaggaatgagggtgaccctaccracacttcagtgtcagacctcaggccttcagaactgtgagggaatatacttaagtcttcttatgcaattcagtttatgataatttcttagaatagccctag

SEQ ID NO: 118515 - DNA, 201 bp, Bos taurus
ttaaatcaaccctacttcaatagaaaaaattaaaatagagcgagacagccttggttagacaacaatgtgacagagtcagtaagtgcagaagaaatcagagyggcaagaacaactgtggactagggtagctggaaaaggcttcatgcaggtgatgggacaaaatttggaagtctcaaaacatcctttagctaattttacatc

SEQ ID NO: 118516 - DNA, 201 bp, Bos taurus
gagttttcctgtatcttaatatgtcattttaacatccagtgtaacattcagaagcacattttattgaattattgaatctcagggccattaagtccaaatcyttatctgatacctgaacaccatttaaaatgccttttacttttaatttactttttagtgcacttttttagaaaggttatttaaggattccatgtgatacac

SEQ ID NO: 118517 - DNA, 201 bp, Bos taurus
tccctcttctgtgagagaaattaacttacacatctatgatttttctttagttgacttaaggagctaaaggcaaaatgtgtgcataatacacacatatatamacacaattttctgatgatgcacctcgtgtgaaatgcagagaatgtttaaagttgatgaaaaggaaaacaaggtatttaacaaaatacaaataaacttaat

SEQ ID NO: 118518 - DNA, 201 bp, Bos taurus
attgttaactcttggctttcagggcccatccattttccccaggctttcggaaagtgcaagacttcaaagcaacatttcagtgcaaacataggaagctttgrttcacctgtggggcctgggtttttttgagtaaatatttcgcaaacccctctcccaacatccagccttctatgacctcagcaattctggtcgttccaggac

SEQ ID NO: 118519 - DNA, 201 bp, Bos taurus; identical to SEQ ID NO: 77251

SEQ ID NO: 118520 - DNA, 201 bp, Bos taurus; identical to SEQ ID NO: 77252

SEQ ID NO: 118521 - DNA, 201 bp, Bos taurus
gttggtttggtggctggccctagatagtattcagggcaaggtgaatgccttagaccggaacttctaaccccttttcaatagtaacagccacttcccaaggractcagtgtgtgtcaaaggccacactcatgcagaccctgtcctgtgcattgcagggcagccttccaattgaaggggtaccctaaccccctcctcatttgt

SEQ ID NO: 118522 - DNA, 201 bp, Bos taurus
tatgtgtttctaattcctttccttatctgaagctcattcttcagtaaatgctttagggaaggcccataaggaataatactttctgagcttattcagattgrtaataatttgtctgtgccccttgtactttccttttccttttcttctcttaatatcttaaacatgttactctattttcttctcccataaagtgttgctgtc

SEQ ID NO: 118523 - DNA, 201 bp, Bos taurus
gtgcacatgctcgccggcctggcgggaatcttttccagtgaagtgatttttcactttgtccgaggaggcaggagaaaaggctcgatcatctgtcagacackggagggggttgggggccctaaaacgcaaagggtttcagctttgtctgggcttccaggggcttggggtttgtgtatttttagagttatttattcttgactc

SEQ ID NO: 118524 - DNA, 201 bp, Bos taurus
gaactaatactgggagttattcatagaaattggaagtatgcactgtttagcactgagagccatacctgatttattatagtaggtgctcattaaatgtttckagagtttaaagaagacacacattagttgtcataggaaatgtcactgagggtggaagaataacttgtttgaagtcagtagacctgaattccaatcccatct

SEQ ID NO: 118525 - DNA, 201 bp, Bos taurus
aacccctgttctccctccctttctcctttctttcctccctcctcctccccttcctcccttgcgtagtattttttgaagagcgagtactattccagaagctrtaactgtttcccagctggacccagcagtgaaaagtctttgctattgtgttacctggtagggtacgtcccaggatcaacagtccatttcccttgagaggga

SEQ ID NO: 118526 - DNA, 201 bp, Bos taurus; identical to SEQ ID NO: 77258

SEQ ID NO: 118527 - DNA, 201 bp, Bos taurus; identical to SEQ ID NO: 77259

SEQ ID NO: 118528 - DNA, 201 bp, Bos taurus; identical to SEQ ID NO: 77260

SEQ ID NO: 118529 - DNA, 201 bp, Bos taurus; identical to SEQ ID NO: 77261

SEQ ID NO: 118530 - DNA, 201 bp, Bos taurus; identical to SEQ ID NO: 77262

SEQ ID NO: 118531 - DNA, 201 bp, Bos taurus
tcccttctcaacctcgttctgtcctgcattgttgcggggcctttcaggcatacatgtgcccccacctccagcccagggtcttaccttgtttccatctcccrcagatgactgctttttggccatcccttgtgagagatgggccagaggcagagtcctgtgatggtcccagaagcagctcaggaccatttggataggacatct

SEQ ID NO: 118532 - DNA, 201 bp, Bos taurus; identical to SEQ ID NO: 77265

SEQ ID NO: 118533 - DNA, 201 bp, Bos taurus
tgtcagtccttctgagggggcaaggggaggcgctgggcacctccacagacccagaggaatggcctgaccccgtgaggcctcacttggggtagggagctggktgagtatgtcacactgtgaaggaaactgcagtctgcttcaggtcaaagaaggggcaggaagcccatccagctgcagagaaggccttgagagtaaaggtaa

SEQ ID NO: 118534 - DNA, 201 bp, Bos taurus; identical to SEQ ID NO: 77266

SEQ ID NO: 118535 - DNA, 201 bp, Bos taurus; identical to SEQ ID NO: 77284

SEQ ID NO: 118536 - DNA, 201 bp, Bos taurus; identical to SEQ ID NO: 77285

SEQ ID NO: 118537 - DNA, 201 bp, Bos taurus
ggaggagactgtccctggcgagtctgcagccctgcgtgaatggtatagagttccaggggtgtgcatattcctggcaggtagaggattagactttttctctktattaactcccacgggggccattgaacagaagaccgactctggtagaaattgccggtgtcttgaagggccaaagaattgatgcttttgaactgtggtgtt

SEQ ID NO: 118538 - DNA, 201 bp, Bos taurus; identical to SEQ ID NO: 77289

SEQ ID NO: 118539 - DNA, 201 bp, Bos taurus
gtgtcaggattttgacgcccttggccctagccagctgttgggtttcactggtgagggttttgtatgaacatgggactgagggtcctttttggttatgttckccgctgccttttctttggcccgtcctcctgctgcttcaaacgctggggatcttgtcaatggtcatgcctttccccagtgcctgcccctctgccaaacgga

SEQ ID NO: 118540 - DNA, 201 bp, Bos taurus; identical to SEQ ID NO: 77290

SEQ ID NO: 118541 - DNA, 201 bp, Bos taurus
attaaaaactctttacaatgcatgtttcagaatttcatctctcattgattctcatgtgtgatcaacttttcccagaatcagttaacccaagttgccaagtygcagatttctgtggctgcttatgacagaatatgagaaaagatgcggggagaacaatgttaaaaagcaaaacatacatgaaggaacctactagggagtcag

SEQ ID NO: 118542 - DNA, 201 bp, Bos taurus
ttgactccagatcacactggcctatgaccaggcaggacttattcccagtccactaacagccagactactgtctgctacagcccactccccaggccctgcayccattcttcagttcttccaagcattaggactatagagcaaatatcattgtccttaactatatgcctcacttaatcctcatgagtaactttaagcaattct

SEQ ID NO: 118543 - DNA, 201 bp, Bos taurus
aattctatctcttttgtactaatgggagatcctgtctttagtaaattttaaattcctttatgtaactgaccccatttctggacttcttattcatgtgttayttgttgaggctttataacatgtttcaattatataatgggtctgtcatcactctacttttaaagagttcttctgatgattcttaattatattcctaaactt

SEQ ID NO: 118544 - DNA, 201 bp, Bos taurus
gctccagattaaaagattttaaagagacattaaaatgaaatgcagaattccctggtgatccagtgattaggactccaggctatcactaagggctcaggttygatcccagttggggaaccaagatcctgctaactgctcagtgtggccaaaaataaaataaaataaaaactaaatgcaatgtgtaataaaggattgggactc

SEQ ID NO: 118545 - DNA, 201 bp, Bos taurus
taaagtatactttacagtagtctgtgtctgttagatttttgagatgggatttctgttttaataatgattttatatgctagtagatattggttccattttcyttgtctatagttaaaagtattagaccagtttgaagatgactgaactgttttgttttttttttaagttgctattttataatttatgcactttgcttctgtg

SEQ ID NO: 118546 - DNA, 201 bp, Bos taurus
ccccagttccagcctcgagtccattccttctacctctggcccccacggctccagaaccaccaagatgccagaccaatgcttgcccaccatggccaccccaycccagattgtccttgagtccttctctgggtgcacacaccctgaaggcttctctgccccagagaaggcctgggtttggagtcactccctggtgacacagga

SEQ ID NO: 118547 - DNA, 201 bp, Bos taurus; identical to SEQ ID NO: 77293

SEQ ID NO: 118548 - DNA, 201 bp, Bos taurus
ccagcggagaagcagcgcagatgcctgcgcccgccactagcaagtggggctgggcagggaggcgtgggctgcatggcttagagtaaggataggccggaatrctctcacgggtaatcacagcgaactaatttgggctagcaaaccagactgtgggatagctaccacaggaaaagccctaagacactgccaggcccacacaca

SEQ ID NO: 118549 - DNA, 201 bp, Bos taurus; identical to SEQ ID NO: 77294

SEQ ID NO: 118550 - DNA, 201 bp, Bos taurus
aaaaaagcaaagttgtctccctctaaaatatgaagatcattgccctatgagacaagggtgaatagagagaacacatatttaggacagaaatggaagtcttrgaaggaaaaatcttttaatttaattaaaatcattactaatctcagatagactcatagcatcctttaattggtgcagtggatttatggcatttgcacatta

SEQ ID NO: 118551 - DNA, 201 bp, Bos taurus
atctgtttaaaccaccggaaaaacccaggccctgatttttaggactgaagatatatttaaatttgttgtaggtgttcatggacattgagatagtttcagtrttatgtcagtttcttgaaaggtgtgttatttaactttgcaacatctctgtgagatggataaggggaaattttcattttttctgtagatttaacatgtaaa

SEQ ID NO: 118552 - DNA, 201 bp, Bos taurus; identical to SEQ ID NO: 37582

SEQ ID NO: 118553 - DNA, 201 bp, Bos taurus; identical to SEQ ID NO: 37583

SEQ ID NO: 118554 - DNA, 201 bp, Bos taurus
tggccatgttgatagctgtggaaaactggaggtgagggatggagccctcccgggtggtttgacctactttctcgcatcctctcattttagcttctttgcayccctaagccccggccccctgtatagctaggtgaccatccctattttaaatgaccagaccagtgtacagggacgttgtccaaggtcagacagctagtcagt

SEQ ID NO: 118555 - DNA, 201 bp, Bos taurus
acacaggtcgtgagcctgtgtggaattccgtatgctggggtagaggtcacctttaggttctagacggatatctagtcatttggtaaataccaacagttccrgtaagaacatgccattttccaacgtaactgtgacatagtagtattagaaataagtcaagatagaaatatggaggaaagagaataatcttctgtttcctcg

SEQ ID NO: 118556 - DNA, 201 bp, Bos taurus; identical to SEQ ID NO: 37585

SEQ ID NO: 118557 - DNA, 201 bp, Bos taurus; identical to SEQ ID NO: 37588

SEQ ID NO: 118558 - DNA, 201 bp, Bos taurus; identical to SEQ ID NO: 37590

SEQ ID NO: 118559 - DNA, 201 bp, Bos taurus
ggtactgtcatgcttgctataaaaatttcccttttcttcaatccctcaaactacatataagttgtaactgaactgttcctctataaaagaaacaggtaatyggctgaaatttggctataaaacaagtattcccatccaaattcttcctatggctctctgaaattgtgatagcttgtaactctactggtcatacattaagca

SEQ ID NO: 118560 - DNA, 201 bp, Bos taurus; identical to SEQ ID NO: 37591

SEQ ID NO: 118561 - DNA, 201 bp, Bos taurus; identical to SEQ ID NO: 37637

SEQ ID NO: 118562 - DNA, 201 bp, Bos taurus; identical to SEQ ID NO: 37638

SEQ ID NO: 118563 - DNA, 201 bp, Bos taurus; identical to SEQ ID NO: 77348

SEQ ID NO: 118564 - DNA, 201 bp, Bos taurus; identical to SEQ ID NO: 37639

SEQ ID NO: 118565 - DNA, 201 bp, Bos taurus; identical to SEQ ID NO: 77349

SEQ ID NO: 118566 - DNA, 201 bp, Bos taurus
aagcatagtttgagaagcctatcataaatagagatgcatggagacgctgagtttctagagagcttatgtatcataagtaagactttttcagttgatttaargtcttcaggatggtctaagcctgaaaccaaaaagaaaaccaaaataaagctgataaatttgactaccaagaaatgtaaaatttcagtttattttacaaaa

SEQ ID NO: 118567 - DNA, 201 bp, Bos taurus
tccaggacactttcttttcttctttcaaggcctctcttcctctcttcttcctgcctagctcctcctcattagtgaggttcttgtgcttaaatactgtgacycaatcctccataacacttcctacattcctatcaaaagtacacaggaaccagtgattctaaacccctcccttccttggtaggaaatgtatctgtgctgaaa

SEQ ID NO: 118568 - DNA, 201 bp, Bos taurus
tgtatggtttgagcttgtgatttttttcaaagaagaatgaaaaccagaatttgacattcgagatttgaaatccatttcaaaatcattttataacagacccrattgtgactcagcagttatttatcttactcttgtcttttcttttctgttcacccatagattataaaaaattgaacagagtcaagtgaattaccagagaac

SEQ ID NO: 118569 - DNA, 201 bp, Bos taurus
tgcattctttggcaagacatttaactaactgcctggccagtggagtgcagaatagtaaaattaggcattgacaaatgtttgcagttttgaggaagacttgytcctaaacttcttgggattggcctctgctcagtcctgtgtctcagcgaccatcctatgggatgtcatatggctacagtcaggaaacccttacaactcaga

SEQ ID NO: 118570 - DNA, 201 bp, Bos taurus; identical to SEQ ID NO: 37646

SEQ ID NO: 118571 - DNA, 201 bp, Bos taurus; identical to SEQ ID NO: 37648

SEQ ID NO: 118572 - DNA, 201 bp, Bos taurus; identical to SEQ ID NO: 37649

SEQ ID NO: 118573 - DNA, 201 bp, Bos taurus; identical to SEQ ID NO: 37651

SEQ ID NO: 118574 - DNA, 201 bp, Bos taurus
gccctctgctagctgtgagagaatgcacgtaagggggtcaggtcctagagggcagccttcatatcttttgctggaatcatcaaggccctgaaatgaggggraaaattatttttaattgcatgtttatgaactattgcaggagagggaagtgtaggagagggaaaagtgttcatccaccctcttaggttccctggctggcct

SEQ ID NO: 118575 - DNA, 201 bp, Bos taurus; identical to SEQ ID NO: 77367

SEQ ID NO: 118576 - DNA, 201 bp, Bos taurus
tgccttatacagatggtgaggatatctgtgcaagaaaaatgagctaaaaacttcatttaaatagctttgggatagtatctttttgaatttccagagaggaraacccacaactgcatatgtaagagaacaggaaaggatgttttcattttttttataaatgtgcttagtatgactcaagggtaattgttatgcaaaagagag

SEQ ID NO: 118577 - DNA, 201 bp, Bos taurus; identical to SEQ ID NO: 37655

SEQ ID NO: 118578 - DNA, 201 bp, Bos taurus; identical to SEQ ID NO: 77369

SEQ ID NO: 118579 - DNA, 201 bp, Bos taurus; identical to SEQ ID NO: 77370

SEQ ID NO: 118580 - DNA, 201 bp, Bos taurus; identical to SEQ ID NO: 37657

SEQ ID NO: 118581 - DNA, 201 bp, Bos taurus; identical to SEQ ID NO: 77374

SEQ ID NO: 118582 - DNA, 201 bp, Bos taurus; identical to SEQ ID NO: 77381

SEQ ID NO: 118583 - DNA, 201 bp, Bos taurus; identical to SEQ ID NO: 77384

SEQ ID NO: 118584 - DNA, 201 bp, Bos taurus; identical to SEQ ID NO: 37674

SEQ ID NO: 118585 - DNA, 201 bp, Bos taurus; identical to SEQ ID NO: 37675

SEQ ID NO: 118586 - DNA, 201 bp, Bos taurus; identical to SEQ ID NO: 37677

SEQ ID NO: 118587 - DNA, 201 bp, Bos taurus; identical to SEQ ID NO: 37678

SEQ ID NO: 118588 - DNA, 201 bp, Bos taurus; identical to SEQ ID NO: 37679

SEQ ID NO: 118589 - DNA, 201 bp, Bos taurus; identical to SEQ ID NO: 37680

SEQ ID NO: 118590 - DNA, 201 bp, Bos taurus; identical to SEQ ID NO: 37681

SEQ ID NO: 118591 - DNA, 201 bp, Bos taurus; identical to SEQ ID NO: 37682

SEQ ID NO: 118592 - DNA, 201 bp, Bos taurus; identical to SEQ ID NO: 37683

SEQ ID NO: 118593 - DNA, 201 bp, Bos taurus; identical to SEQ ID NO: 37684

SEQ ID NO: 118594 - DNA, 201 bp, Bos taurus; identical to SEQ ID NO: 37685

SEQ ID NO: 118595 - DNA, 201 bp, Bos taurus; identical to SEQ ID NO: 37686

SEQ ID NO: 118596 - DNA, 201 bp, Bos taurus; identical to SEQ ID NO: 37687

SEQ ID NO: 118597 - DNA, 201 bp, Bos taurus; identical to SEQ ID NO: 37688

SEQ ID NO: 118598 - DNA, 201 bp, Bos taurus; identical to SEQ ID NO: 37689

SEQ ID NO: 118599 - DNA, 201 bp, Bos taurus; identical to SEQ ID NO: 37690

SEQ ID NO: 118600 - DNA, 201 bp, Bos taurus; identical to SEQ ID NO: 37691

SEQ ID NO: 118601 - DNA, 201 bp, Bos taurus; identical to SEQ ID NO: 37692

SEQ ID NO: 118602 - DNA, 201 bp, Bos taurus; identical to SEQ ID NO: 37693

SEQ ID NO: 118603 - DNA, 201 bp, Bos taurus; identical to SEQ ID NO: 37694

SEQ ID NO: 118604 - DNA, 201 bp, Bos taurus; identical to SEQ ID NO: 37695

SEQ ID NO: 118605 - DNA, 201 bp, Bos taurus; identical to SEQ ID NO: 37696

SEQ ID NO: 118606 - DNA, 201 bp, Bos taurus; identical to SEQ ID NO: 37697

SEQ ID NO: 118607 - DNA, 201 bp, Bos taurus; identical to SEQ ID NO: 37698

SEQ ID NO: 118608 - DNA, 201 bp, Bos taurus; identical to SEQ ID NO: 37699

SEQ ID NO: 118609 - DNA, 201 bp, Bos taurus; identical to SEQ ID NO: 37700

SEQ ID NO: 118610 - DNA, 201 bp, Bos taurus; identical to SEQ ID NO: 37701

SEQ ID NO: 118611 - DNA, 201 bp, Bos taurus; identical to SEQ ID NO: 37702

SEQ ID NO: 118612 - DNA, 201 bp, Bos taurus
gctcctgaagctgagcagccccgcctctccctgcaccggggccacttttcagcctggggggaccaggacacagagccaggtttgggagaaccccagtgacractcaggacaggcccatccttagcgagagcctgactgagctctgagcactgccattcccccgagcgctcatgggagccaaggaaacagaaagttaccccg

SEQ ID NO: 118613 - DNA, 201 bp, Bos taurus
gaccctgaatccgggcgggctctctcatccgggctttcccacagggcagaccacgcgtcagccaccacccaaacaaacacctccctcctctgaggccaggrcaaggtctctgctcacaagcagtcgtgttctgacccctccctgcacaggcatcacgtaaattcgtcaggaaggcaggttctcaggccctacgacgctgct

SEQ ID NO: 118614 - DNA, 201 bp, Bos taurus; identical to SEQ ID NO: 77407

SEQ ID NO: 118615 - DNA, 201 bp, Bos taurus; identical to SEQ ID NO: 77408

SEQ ID NO: 118616 - DNA, 201 bp, Bos taurus; identical to SEQ ID NO: 37705

SEQ ID NO: 118617 - DNA, 201 bp, Bos taurus
gtcttaaccctttggggtccaggccagtgaccatgggagggcctgctccctgccgaggcaggcgtaagcactctgcccaccaccgagctgccagaagagcmcactgactggcgactggccagaacagcacccagaatcttccaggatgtgctgcccacccaagcatctgtccatctttgaatgagcagtgggaatgagggg

SEQ ID NO: 118618 - DNA, 201 bp, Bos taurus
attcttgtctggagaatcccatggacagagcagactgacgggctacggcccatagggtcacagagtgttggacatgactgaagcaacttagcacacaagcrtatgtaaaactctagaagaatcaaaatggatctacagtgataggaatcagacccggggtggcctaaggtggagggtaaggaaggattgtctgcaaaggat

SEQ ID NO: 118619 - DNA, 201 bp, Bos taurus
acagaccctcccacttccccagccagcggggtcatctccacccccctctcacactcatcattacatcacacacatgggaccacctccaggaggcctacagrcaagtcaaccgctcttcacaccaacacctgtcctgtgctcaggtcatccaagaaccaagtggggagggagctagtcccctcagtgcacagcagcgtaccc

SEQ ID NO: 118620 - DNA, 201 bp, Bos taurus; identical to SEQ ID NO: 37708

SEQ ID NO: 118621 - DNA, 201 bp, Bos taurus; identical to SEQ ID NO: 37710

SEQ ID NO: 118622 - DNA, 201 bp, Bos taurus
ctctgggagttggtgatggacggggaggcctggcgtgctgcggttcatggggtcgaaaagagtcggacacgactgagcgactgatctgatttgatgattcyggccaaaatgaagtaacagggatcagaattactctttcacctgaagcaactaaaaaaccatacaaaatatgtgaaaacagttctaaatacattggctgca

SEQ ID NO: 118623 - DNA, 201 bp, Bos taurus; identical to SEQ ID NO: 77422

SEQ ID NO: 118624 - DNA, 201 bp, Bos taurus
cccttgagagaacctccttttggcgcccccaggactcctgcaggaggtggaccagcccccagagacttaaggtgggatcaggcccgttcatttgtttcccrtgaatcctcagctgagtgcttacacagggactggggttcagcgctcaccaccgccgtggccagtaactctttcagctgctcattcagacactcaggtggt

SEQ ID NO: 118625 - DNA, 201 bp, Bos taurus
cggggtaccgctggacattgggacctccaaccggcctggggcgaggtaaggccagcaggattcggggacacgtgtcgggcagcctggcggccaccgtgcayacaaaactcatggagaggcgctttcgctcacccagagtggagttggaagtcagtgtctggccccaaagtatcctctgggagcagggaagcatgtcgggtt

SEQ ID NO: 118626 - DNA, 201 bp, Bos taurus; identical to SEQ ID NO: 37715

SEQ ID NO: 118627 - DNA, 201 bp, Bos taurus; identical to SEQ ID NO: 77431

SEQ ID NO: 118628 - DNA, 201 bp, Bos taurus; identical to SEQ ID NO: 37716

SEQ ID NO: 118629 - DNA, 201 bp, Bos taurus; identical to SEQ ID NO: 37718

SEQ ID NO: 118630 - DNA, 201 bp, Bos taurus; identical to SEQ ID NO: 37719

SEQ ID NO: 118631 - DNA, 201 bp, Bos taurus; identical to SEQ ID NO: 37720

SEQ ID NO: 118632 - DNA, 201 bp, Bos taurus; identical to SEQ ID NO: 37721

SEQ ID NO: 118633 - DNA, 201 bp, Bos taurus; identical to SEQ ID NO: 37724

SEQ ID NO: 118634 - DNA, 201 bp, Bos taurus
atcgatttgtgtatgtgttagtatctgtcttcttcccccagggccagctgtatggatatgtaacctgtgtagtcacacagggccccgtgtttggcagggtytaatgcttggtttaacactctatggttacccgccttgaatttctgcttttgaataagggatcccctattttcatttttcactgggcctacaaatgatgtc

SEQ ID NO: 118635 - DNA, 201 bp, Bos taurus; identical to SEQ ID NO: 77442

SEQ ID NO: 118636 - DNA, 201 bp, Bos taurus; identical to SEQ ID NO: 37730

SEQ ID NO: 118637 - DNA, 201 bp, Bos taurus
tcctcctggcccagaaggaccccatcctgtgtacgcccttcctcttctaccacagagccacctaccaccccctgaacgacaggcagaaggcctcgggcgcrcgcaggaagagcccctacgcccctgacaacccgccgggaaccgccttcaccgacatgaaggtgttcgaggtccacttcccctgggaggcctacactctgg

SEQ ID NO: 118638 - DNA, 201 bp, Bos taurus
gactgcaaaacgtctcttttggctttctgctccagcatttagaatgtttctttctgtgcatccagttccctctcccagcataagccagctcagagcccccyctctctctctgcagcctaccaatgtctcctctcctagaacctggagcatggccacaatgttgagacacccttccactgaaaccagcagaaatggtctcaa

SEQ ID NO: 118639 - DNA, 201 bp, Bos taurus; identical to SEQ ID NO: 37737

SEQ ID NO: 118640 - DNA, 201 bp, Bos taurus
ccagcctccaaagggatatgtttgaattttcacctttcatcttagtaagatttcttacaatgttatttagccaatcattatttttaggtattccccactgycatcctccaaagagccaaagagcatgttatttatattgttaaatgaatatttatttatagacttaaagtggatgaattactatagttgtttcaactttct

SEQ ID NO: 118641 - DNA, 201 bp, Bos taurus; identical to SEQ ID NO: 77447

SEQ ID NO: 118642 - DNA, 201 bp, Bos taurus
tcatttgctgattgaatgaggtatgtatgcatcccctatacaggccttggagaagagtaagacaaatacctttccttacatggggtaagagggggacaggycacgctactcaagagggctcaaaaattccacaacagttacaacatgctgggaagggtgataagggtctggttttttctgttcctacattccaacaccttt

SEQ ID NO: 118643 - DNA, 201 bp, Bos taurus; identical to SEQ ID NO: 37739

SEQ ID NO: 118644 - DNA, 201 bp, Bos taurus; identical to SEQ ID NO: 37740

SEQ ID NO: 118645 - DNA, 201 bp, Bos taurus
cttaaatctttgtgaaaaggagctaaaaaaaaaaaattttacttctatctctacaatgctataagtaaaaaaaaaaaaaaaagtaactcaatccctgtgcytatcctctggtctctattttcttctccctcacctctgagttttcaaattatcactttatcccaaccactattagtgtatcaacaatcttcttatgaaatt

SEQ ID NO: 118646 - DNA, 201 bp, Bos taurus
cacagatcggatagcttaaacaacagatattttttcaaaattctggaggctagaagtccaaaatcaaggtgtaggcaggcttggttttttccaaggcctcrctctttggcttgtagacagccatcttctccatctgtcttcacacggtcttcaccatcatgtctgtctgtgtactatctcctcttcttataggggcactag

SEQ ID NO: 118647 - DNA, 201 bp, Bos taurus; identical to SEQ ID NO: 37742

SEQ ID NO: 118648 - DNA, 201 bp, Bos taurus; identical to SEQ ID NO: 37743

SEQ ID NO: 118649 - DNA, 201 bp, Bos taurus; identical to SEQ ID NO: 37744

SEQ ID NO: 118650 - DNA, 201 bp, Bos taurus; identical to SEQ ID NO: 37745

SEQ ID NO: 118651 - DNA, 201 bp, Bos taurus; identical to SEQ ID NO: 37746

SEQ ID NO: 118652 - DNA, 201 bp, Bos taurus
ggtgtcagaaaggcaccttaccttggggttggtgattactttggtccctctgcgtgtcacttagtctttctcagtctgctcaacttactgaatggacatartaaacccagcccaaatgtgactgctgggtttctggcccgtgcatcttgttgagggtgaaccatggaagagcaagttggggtgtaggggatgggttgtgtc

SEQ ID NO: 118653 - DNA, 201 bp, Bos taurus
caggtgcattttttccatcacattaggccataggtggcctccatatgcagcacttttcaaagagcagtcctcgggatgattcttgaatattatctggcaarcacttcaagcaacaggcccatctctttgaaaataattatacatataatccaaatgcattctgtagttggaattggctacctgttggctatatttcagaag

SEQ ID NO: 118654 - DNA, 201 bp, Bos taurus; identical to SEQ ID NO: 37749

SEQ ID NO: 118655 - DNA, 201 bp, Bos taurus
acatacacatattgagacattagagcccattcgggctggtctgtgtaataaggtcacgttcaccactcttgcctgatacattttcgaggccagacagaggkaaggagctccagggcatgtggggagaggctgtaagtcacaggctttgtccagggaagaggccgagtcccctgtgatttgagaccatgggcatatggggag

SEQ ID NO: 118656 - DNA, 201 bp, Bos taurus; identical to SEQ ID NO: 77463

SEQ ID NO: 118657 - DNA, 201 bp, Bos taurus
gaaattcagctctcattttcttttttcccttttttcttttttttaaataacaatcaaattaccttgttaaatcaactcaaattaccaagttcttatctagrgcaaccagtatggagacagatgtggtgggagatcccaagtatttcaccatgaaatcatagggagatcaagtaacatggaatcataaaatactgattccaa

SEQ ID NO: 118658 - DNA, 201 bp, Bos taurus; identical to SEQ ID NO: 37753

SEQ ID NO: 118659 - DNA, 201 bp, Bos taurus; identical to SEQ ID NO: 37755

SEQ ID NO: 118660 - DNA, 201 bp, Bos taurus
gtcacaactaagacccaatgaagccaaataaaaacataagtaaagctggtagaaactgaaggaagtgtcaaagaggaacagtttgtagcaagtccagagaktcggaggtacccccatggttatactgggcagcttcctgcatgacagctctgtagtgagggttctgtgtgtattacaacacatttgaccctatgatggctc

SEQ ID NO: 118661 - DNA, 201 bp, Bos taurus
actttcgtctgcatgtgattctgagttacagaacacacgtgaccaacatacattccttgggcatcgctgcctgagtgtggaatgggaggggcccgccttckatattatccttccatccaatgagaatgtgggtggcagacagcaagacaggtgtataccagaggagggaaagcctggacagggattcaggaggcctggtac

SEQ ID NO: 118662 - DNA, 201 bp, Bos taurus; identical to SEQ ID NO: 37756

SEQ ID NO: 118663 - DNA, 201 bp, Bos taurus; identical to SEQ ID NO: 37757

SEQ ID NO: 118664 - DNA, 201 bp, Bos taurus; identical to SEQ ID NO: 77468

SEQ ID NO: 118665 - DNA, 201 bp, Bos taurus; identical to SEQ ID NO: 77469

SEQ ID NO: 118666 - DNA, 201 bp, Bos taurus; identical to SEQ ID NO: 77471

SEQ ID NO: 118667 - DNA, 201 bp, Bos taurus
atacacatgcatatatacatgtgtgtatatatacacacgcatactttgaggcagcccaatcaactttgaaattgcttagaaaccaaatcacatttgagaamcacaatttataagccacaaagcattaagaaaatttctcagagaagaaatgagctttttgcttctttaccagtctccagggctctattcaattcagaaaac

SEQ ID NO: 118668 - DNA, 201 bp, Bos taurus
agtgaattgttcgctgtaattttcccctctaccttttcctaacatagtatttatctgaatgtaattgtaagaaaagatataatcatcttgactcaagccaygatacccctgaattcctggccttatatctcttttctgtaactttgctactgactacaaatactaatggctctaaagcaaacagatatggagatggtgttg

SEQ ID NO: 118669 - DNA, 201 bp, Bos taurus
gctgaaggctggttcctcccactcacaggccctggaggctgcgctgggctcacctaccactgcctctgtcccttgctcctcctgctgaggatgcagagccrtcctggccctctgaatgtctcctccagctctcagggttggttcctcctctagatgtgatcttactcttctgacccctctcctgtttctcttaccaaaaca

SEQ ID NO: 118670 - DNA, 201 bp, Bos taurus
cctggccaagccattactagcagtactgggctctgacaccatctcattttcttggcttcctatcctggcttcttagttaaaagcatggaaattttctgaayttcttgggccctccatttcttcatctgaagcttgggttcctaactggctcattttttaggactatggatactgtgagtaagtaagtataaggaacttaac

SEQ ID NO: 118671 - DNA, 201 bp, Bos taurus; identical to SEQ ID NO: 77474

SEQ ID NO: 118672 - DNA, 201 bp, Bos taurus; identical to SEQ ID NO: 37763

SEQ ID NO: 118673 - DNA, 201 bp, Bos taurus; identical to SEQ ID NO: 37764

SEQ ID NO: 118674 - DNA, 201 bp, Bos taurus; identical to SEQ ID NO: 37765

SEQ ID NO: 118675 - DNA, 201 bp, Bos taurus; identical to SEQ ID NO: 37766

SEQ ID NO: 118676 - DNA, 201 bp, Bos taurus; identical to SEQ ID NO: 77476

SEQ ID NO: 118677 - DNA, 201 bp, Bos taurus; identical to SEQ ID NO: 37768

SEQ ID NO: 118678 - DNA, 201 bp, Bos taurus; identical to SEQ ID NO: 37769

SEQ ID NO: 118679 - DNA, 201 bp, Bos taurus; identical to SEQ ID NO: 37770

SEQ ID NO: 118680 - DNA, 201 bp, Bos taurus
ctttttccactcttatcaggtgagaatatacatatgactttgtatccccaaactaagtcatcaataatactgacatattcagtaccttaagacagatacayttttagttctttcagaacaaaatataatgtatttgttatagtattttcaagtcaactataacatagatgttagagaaaacatctgtatcttcagtggcat

SEQ ID NO: 118681 - DNA, 201 bp, Bos taurus
ggaatgaacttataaatatgccatctgtaaaaggaaagtgttttcttttattaaagactatcgccaatgaacaacattaccagttaagaattttttgatarcagtctgccaaatgtatagttacattcccaaacattttgtttttcaggtagagggaaagtaatttttctggggattatttattgtaaatgaacaaaaata

SEQ ID NO: 118682 - DNA, 201 bp, Bos taurus
cctaacccacagaggtctatgatgggaactgggctgcaaagaggaatgaatccatagtgctgtgttccccaaatcctgctgcggatttaaagttgaacaaygaattgggagggcagacataaatataactggagttaaaagtttttacactctttttggccagtttttagttgaaaagtttattgcctgtaggtactgaaa

SEQ ID NO: 118683 - DNA, 201 bp, Bos taurus; identical to SEQ ID NO: 77482

SEQ ID NO: 118684 - DNA, 201 bp, Bos taurus
cagacaagttgtaatataaatggagggtggaagacgccagactggtgagaaggggaagtggcagcagataaatgcataggctaacattagtcactgatgcytcgtctcatatctcttactaccactgcagtcttcccattacgttcctcttccagaccatcctgaaaactactttcattcttctcccaaatacccatatca

SEQ ID NO: 118685 - DNA, 201 bp, Bos taurus; identical to SEQ ID NO: 37771

SEQ ID NO: 118686 - DNA, 201 bp, Bos taurus
aagttacaaagttcttttggtttaggactgatagtaataaatacatacatatacacatatttgttcaaataatctataaaaacatactcagaattcaatcyctatgatttcattgctaaactctccagcttaaaacaagatatcaataaaattacaaaatcactgaaaaattttaatgataatcttagttaataaagctct

SEQ ID NO: 118687 - DNA, 201 bp, Bos taurus
aacacatggaatcatatcactttattaggcatccctacctggtcatcaccagtacctgcacatgcaaactattatatgtgaaatactacttttgtttagcwtatgaagattcctccaccatggattcttaagatcctgcctagacttaggcaagggcttcccagtggtcaagaatctgcctgtcaatgcaggagatgcatg

SEQ ID NO: 118688 - DNA, 201 bp, Bos taurus
tctgcagcaactacagctaacatcatgtataatggtaaggaactggaaccttttgtactaacctcaggtacaaggcaaagatgactttgctcaccactttkaaatatcaggctggaagttctagctagtgcagtaagagaaaaggaaataaaaggtatagagattgagaaggaagaactaaaactgtctttattcacagat

SEQ ID NO: 118689 - DNA, 201 bp, Bos taurus; identical to SEQ ID NO: 37775

SEQ ID NO: 118690 - DNA, 201 bp, Bos taurus; identical to SEQ ID NO: 37776

SEQ ID NO: 118691 - DNA, 201 bp, Bos taurus; identical to SEQ ID NO: 37778

SEQ ID NO: 118692 - DNA, 201 bp, Bos taurus; identical to SEQ ID NO: 37779

SEQ ID NO: 118693 - DNA, 201 bp, Bos taurus; identical to SEQ ID NO: 37780

SEQ ID NO: 118694 - DNA, 201 bp, Bos taurus
cctctttaagcaaggcgtgtacagtccttataatggaaacaggtttcaggcacaataacccacatgctcacttatcccagaagcactaaagcagtttggcragttgtttaccatccaggtattcctgattcagcagttttcatacaattatgatttaatttccctatgctctaccctcccaaaaagtactaagaaatcgaa

SEQ ID NO: 118695 - DNA, 201 bp, Bos taurus; identical to SEQ ID NO: 77496

SEQ ID NO: 118696 - DNA, 201 bp, Bos taurus; identical to SEQ ID NO: 77498

SEQ ID NO: 118697 - DNA, 201 bp, Bos taurus
gttacctgccaaacctgggattcaaatccaggcaaaggctctgctcctcccactgcgtcctggggcctctcctgttgggaggccggttttccattgtgggrattgtcttttggtcatttaggggcttatcaggactgtggcaaggaaggggataagggataggggaccagggatgagaggacgcccaaggccccacagctc

SEQ ID NO: 118698 - DNA, 201 bp, Bos taurus; identical to SEQ ID NO: 37781

SEQ ID NO: 118699 - DNA, 201 bp, Bos taurus; identical to SEQ ID NO: 37782

SEQ ID NO: 118700 - DNA, 201 bp, Bos taurus
tttctaaccttgtctgggatcatctggaaaggatcagcaggaggatttgggaacctggggtgctaaatgactaattcagggtctaatttgtggggccccayggagcggctgagcatatcccaaggtgcacagctggtttttcaaagtgttgctattataggattattggaaatggcaagtgggcctcaagcatggggcctc

SEQ ID NO: 118701 - DNA, 201 bp, Bos taurus
gggcaccatactgttcaagttagttgttacttgttgccagagaggcaagaaataaaatgacaggtgtatcactggggtcatactaggccatctgggattgmatttctttcttggatagttggaggcaatctgttgtggagccatccggttggtaggtgtggccctctgcctacaagaagaagggggctgtcaaggagggtt

SEQ ID NO: 118702 - DNA, 201 bp, Bos taurus; identical to SEQ ID NO: 37783

SEQ ID NO: 118703 - DNA, 201 bp, Bos taurus
gcgtgtgtggaaaggctgggagacgacttttcctgtgagcatactggcctctgggaggggtgcagacagtgtccgtggagacgatggtggtggccctgtcyatgtctggggtttaggcatgaggtcccgtctctgccctacttctggtccctctagggcagatgtgtcgttctccatggcccaggcaggggctatgatctc

SEQ ID NO: 118704 - DNA, 201 bp, Bos taurus; identical to SEQ ID NO: 37785

SEQ ID NO: 118705 - DNA, 201 bp, Bos taurus
tcactcagtgcaatttaacagacaccctgaccttcacaggcaccttgctgggcagttacctagctccctctcccaccttctcgtcccatccccagtggaargtgaagggcaccattctgcatgtagcaaggtttctcaagagttccacatgttcttcttatagtcagcaacaagactgatggagaagccagtcccttgaaa

SEQ ID NO: 118706 - DNA, 201 bp, Bos taurus
tggcccaagatctatgctaagaaaattacttctttaaaatttgacttccagaaaagtttaatgtatgtgtactatatttgtaattcatgcttcttggaagytgaatttgtggttattccactgagtttatatgaacataattccctggttgtatttactatgctcatgagatttagtgatttattattaaacttcttagag

SEQ ID NO: 118707 - DNA, 201 bp, Bos taurus
attaggtaaaaagtcaccagcatggtatcagaactttcttcaagtcaatcctgggatattctgggtgggaggaaagggtccatgctggccatgggccaatyaacaatcaacaggaggtcttgttgatgctcctggttcatccccaggacaacttgctggagtgtatggaactgcccaggagtgaggatgcatggaattggg

SEQ ID NO: 118708 - DNA, 201 bp, Bos taurus; identical to SEQ ID NO: 77507

SEQ ID NO: 118709 - DNA, 201 bp, Bos taurus; identical to SEQ ID NO: 77510

SEQ ID NO: 118710 - DNA, 201 bp, Bos taurus; identical to SEQ ID NO: 77513

SEQ ID NO: 118711 - DNA, 201 bp, Bos taurus
tgcttacatccccaacccttccctgcccctattgtgacctgagccttacacagtgaactcactttttacaaattagcttcccagtggccagctggcttctkcgaaggcaaagggcaggaagccagagagtaaggaagagtgtgcgtgctcattctccatcgctcagtcatgtccgactctttgtagccccatggcctgtaa

SEQ ID NO: 118712 - DNA, 201 bp, Bos taurus
cagacatcttcataagggaataggggcaaagccttcacttaatattagcaacattttccaagtcagccacaccttggttggatatcagcaagagagccttragcagacatccttggcatgatggtggccataatacctcagtggctggagacatcacctaaactgctcagaaaggagaaaatcagtggagacagctgagag

SEQ ID NO: 118713 - DNA, 201 bp, Bos taurus; identical to SEQ ID NO: 77514

SEQ ID NO: 118714 - DNA, 201 bp, Bos taurus; identical to SEQ ID NO: 77515

SEQ ID NO: 118715 - DNA, 201 bp, Bos taurus; identical to SEQ ID NO: 77516

SEQ ID NO: 118716 - DNA, 201 bp, Bos taurus; identical to SEQ ID NO: 77518

SEQ ID NO: 118717 - DNA, 201 bp, Bos taurus; identical to SEQ ID NO: 77519

SEQ ID NO: 118718 - DNA, 201 bp, Bos taurus
atcttcacaaatagtatgtattatcttctctttcttacagcagagtgaactaaggcttaaggaaattaaataccttacttaagatcacaaagctattaagyggtacagctgggatttgaaaacttctcacttctagaattgtgtcagcaaaaatggcaatgaaatctccccatggcatcttgtactgagggttggggagag

SEQ ID NO: 118719 - DNA, 201 bp, Bos taurus
atcagtggagattattgtccagagggccaacatggctggagaattaggtctggacctgtgaccacccaggggtaagacgaactagctacatataccactayagcaggcctcaacgctcctagccaaactgttcaagcttgtgttttgaggctgtttggaaatgtatgactcaggatgccagaatcaaaccaacactgaagc

SEQ ID NO: 118720 - DNA, 201 bp, Bos taurus
atccctaaggcctctatggtacctgacacatagtggaatccttgcatatgtttgatgaatgttcattcaatgaatgtatgaatatacttcagtttactacygtctgttatgactctctgctctggccttctttctgtctttatgtgtttctgtgactttgttttgttttttaactctatttaaatttggtatttttttctg

SEQ ID NO: 118721 - DNA, 201 bp, Bos taurus
aagccttcctcacggggatgctcagcagatcactgtgagcatacacttcttaagtcaaagaaatgtggttgtgaaggccgttgctttcctgatagaggaaygtgtcagtataattatttgtacaaatgcctgttcagttcagttcagtcactcagtcatgtccaactctttgcgaccccatgaaccgcagcacaccaggcc

SEQ ID NO: 118722 - DNA, 201 bp, Bos taurus
cgggtattccacaaagcttctctctctccctctttcccagggcaaggatggctgtgggggtccccttcaaggtgctggggagtcagtcatctagccacacygccttgcaaagacttgcagtgaaaggtaaaaataaggactaacatttacacagtggtgtgaagttacacaggacttgaataatctatgcctcctatatag

SEQ ID NO: 118723 - DNA, 201 bp, Bos taurus; identical to SEQ ID NO: 77520

SEQ ID NO: 118724 - DNA, 201 bp, Bos taurus
gtgtggagagctcgactcatgtggcaaaattagcatgagcaggtgttggagggataagtagagaatgaccatgaccccaaagtagagactgcaggaagackgatctgggattgggcttttctaagtgagtaaaacaaaaagacaagggcatctgaggtatttgcaactgggccaaactagaaggaactgaggatgtaaggg

SEQ ID NO: 118725 - DNA, 201 bp, Bos taurus
tattaactgagtgactgtgaatcctaaatgtgatatgactctgttttcaggataagggaaatcttgaaggcgtcacgaaaattgcaaggtgatcccgactygcccacgtcatttactttggccatagtggagtccgactctaccatagtctactacaaactcactgatggatttatgctgccggatcctcaggtcagtttg

SEQ ID NO: 118726 - DNA, 201 bp, Bos taurus
aatctatggcagcatttcccaaatttatttgatcaagacccctgtatcagttttccatagctgctgtaccaaatcactacaaactcaacagcataaacaayacaaatgccttatcttacagtctgcagattagaggtctcatgatggtctctacaggctcaaatcaaggtgtcagcagggctatgttcctttcttgaggct

SEQ ID NO: 118727 - DNA, 201 bp, Bos taurus; identical to SEQ ID NO: 77523

SEQ ID NO: 118728 - DNA, 201 bp, Bos taurus
gaaagccattgtctacattttgaacagtttgttacagcagaacccaattccaggaatctagaaaactattcagcctattctctgctgattgatttgaatgkgcaaatagatctggaattcatctcatttcctgcagcactaaatatttcaagaagatgaatttatctgggttttaatatgcacagtgccacctgacctgcc

SEQ ID NO: 118729 - DNA, 201 bp, Bos taurus; identical to SEQ ID NO: 77524

SEQ ID NO: 118730 - DNA, 201 bp, Bos taurus
cctgcgtattttggaagtgggctgggctgccagtatcattgcttcgaacagttccttgctccacagcaaacacaacagggccctgcttttgctaataaccsgaccattcctgtgtctcctttcccttcatcccccgcctcgcctactctctgccctgtatgcatcttgcctcattcatcggccaaattaaagctgtgatta

SEQ ID NO: 118731 - DNA, 201 bp, Bos taurus
caaagcaatatatacataatataatcccatttttctaagagcaaacaacctaaaaaaatatatcccacaaaacatgtgttttatatgctatatgaacatgragaaaagcacagaatagcgtatgctaagttgttcacactagttgcttgagttggaggaggggatgtgggggaaggagagaaagttaagttttagaagggc

SEQ ID NO: 118732 - DNA, 201 bp, Bos taurus
caattcctcacttcttaggcgaactcattcatttctacaaattaggactgagacaaatacttatgcaataattcttacccacttcctactttattcggatyaatttttcttacaggggatctaggaaagcgctacacttagtgtactggctaatatgctttgggccataacagaaaacagttatattagttagagtttgac

SEQ ID NO: 118733 - DNA, 201 bp, Bos taurus
gagcacattacctgccatcaagtgcagatacgcatcaggttgagtgagtgattgaatgatacatcatgctttaaaaaaaaaacatgaaaattggcacttasgctcattctgaaaaacctaaaaaagacaagaagaaatttgcttatattcttagcagtattcttgctgctatagattcagaactgattgttggggttgagc

SEQ ID NO: 118734 - DNA, 201 bp, Bos taurus
tccggggtcggggtcgggaccgggacctggaccacctccaccttctcctggggcagcagctcctcctccgccatattctccatagttaccgcctccttgcyaggcccgcccggggaccagcaggggctcactgcggagtgagagaaatggcgtgaaagcccagagggccggatccgagaagtggggaagcaaatggggagg

SEQ ID NO: 118735 - DNA, 201 bp, Bos taurus
acagtccaggttcctctttccaggggttggaaagagtcagacatgacttagtgactaaaccaccaccgtcacccagcagtggaccctaaaggaaaatatarttacctttgtattccaagcttggtaaagaaggtcataattagtaacatgtatttgaaaatgttaagatagtcataatttattctgactgtgtatgttagt

SEQ ID NO: 118736 - DNA, 201 bp, Bos taurus
tcctcctgcttcttaagagaaagataaaaaacgtcttgacacttgcagcctgtttcctcctttggagacccctaggtttcctgcctgttaccctctcagtmacacacaaaataatacatctatttgtaaaaataatgccatattttacaatgagaagtctgcttcctggaagagggctctcacgtgatgatgctggcaccc

SEQ ID NO: 118737 - DNA, 201 bp, Bos taurus
acaagctttgtggcttcattaaaaatgtaaaagtagaatgttctattccgctaagcacgccatgaaagagttatgctgttctttcttctcttgacatttgkaccaaaggagaataagattgtaaacatctgttttatataagccaattccaggcttataacttgattagtatgagaatatttgatgtgattaattttccag

SEQ ID NO: 118738 - DNA, 201 bp, Bos taurus
atgttcccttatgccccttctctgcctctcctcctaccatagagataaccatttttctaataactgtcaccatggcttagttttgcacatgagtgttgccraaagactacgtattcacttgtgacggacttctttcactcaatgcattggttttgcatgtgtaaattcctttttcatgaccaagtaatattcagttatatg

SEQ ID NO: 118739 - DNA, 201 bp, Bos taurus
attttttcgtctccagtaattacgaaaagcatggaatcatgtcaacattcctcagcttctgggaaaacaaacacttgagcacttgagttttttcccagcartattaattaagagaaggacaacagggaaaagagatttcagtgagtggactcaggcgtctcgcataaataactgggaagtgccagaaacgacttgtgaact

SEQ ID NO: 118740 - DNA, 201 bp, Bos taurus; identical to SEQ ID NO: 77532

SEQ ID NO: 118741 - DNA, 201 bp, Bos taurus
ttgtctatagttattattctttctactgttactcctctttcacagtacactttaggagatcccctcatctcatggccctaaatgacaccccccttcacccygactgtgttaagtgctgccataaccataggagatctcctcgcacttatgtctcatagctgcatggaacttgcttactcctttgcatcaatgattgtcaaa

SEQ ID NO: 118742 - DNA, 201 bp, Bos taurus; identical to SEQ ID NO: 77533

SEQ ID NO: 118743 - DNA, 201 bp, Bos taurus
aattatatagattctggccactatttctgtccttctatatggcctgtcttttccttacattgtaaagctttggtttggggcctcagcatttctcacatttmcccaactatcctttaagaatggcaggtagggaaatgaggcatagttaggattatgttgcccattttttagattgtttattagtttttttctctgctctgg

SEQ ID NO: 118744 - DNA, 201 bp, Bos taurus; identical to SEQ ID NO: 77535

SEQ ID NO: 118745 - DNA, 201 bp, Bos taurus
atctgcattaaaatataaaccgaagatgtcttatgatcagcgtatattgtgcccacagtccaactcaagtcattcataatgactttagtgtctcaacagaraaaaacaaaaatataccacccctcttctaaatatattagaagtcaaagcaacaactataaagtttgatgtgttgtttgaggattaaaggaaggaaggaaa

SEQ ID NO: 118746 - DNA, 201 bp, Bos taurus; identical to SEQ ID NO: 37787

SEQ ID NO: 118747 - DNA, 201 bp, Bos taurus; identical to SEQ ID NO: 37788

SEQ ID NO: 118748 - DNA, 201 bp, Bos taurus; identical to SEQ ID NO: 77538

SEQ ID NO: 118749 - DNA, 201 bp, Bos taurus
agaaattggttaggccttgtaagagctttctcacaataaaattaagtctcttttatgattcggtggatattaagtcactaaacttgccagatcagcttctkctctgactaatagaatttggccacctcatgcgaagagttgactcattggaaaagactctgatgctgggagggattgggggcaggaggagaaggggacgac

SEQ ID NO: 118750 - DNA, 201 bp, Bos taurus; identical to SEQ ID NO: 37790

SEQ ID NO: 118751 - DNA, 201 bp, Bos taurus; identical to SEQ ID NO: 37791

SEQ ID NO: 118752 - DNA, 201 bp, Bos taurus; identical to SEQ ID NO: 77543

SEQ ID NO: 118753 - DNA, 201 bp, Bos taurus
taaggtttaggaaaacaaagaacaaaatagacatttatttatcattctaacattgtgacttaatacgacttaatagccaccttaccacatggatagaaaayaaaattagaaaaagactgctgtgtacctaagttatcatcttcataaaaagacaagcatacaatcaatccttggtacctgcagaaggttggttctaggacc

SEQ ID NO: 118754 - DNA, 201 bp, Bos taurus; identical to SEQ ID NO: 77544

SEQ ID NO: 118755 - DNA, 201 bp, Bos taurus; identical to SEQ ID NO: 37794

SEQ ID NO: 118756 - DNA, 201 bp, Bos taurus; identical to SEQ ID NO: 37795

SEQ ID NO: 118757 - DNA, 201 bp, Bos taurus; identical to SEQ ID NO: 37796

SEQ ID NO: 118758 - DNA, 201 bp, Bos taurus; identical to SEQ ID NO: 37797

SEQ ID NO: 118759 - DNA, 201 bp, Bos taurus; identical to SEQ ID NO: 37798

SEQ ID NO: 118760 - DNA, 201 bp, Bos taurus; identical to SEQ ID NO: 37799

SEQ ID NO: 118761 - DNA, 201 bp, Bos taurus; identical to SEQ ID NO: 37800

SEQ ID NO: 118762 - DNA, 201 bp, Bos taurus; identical to SEQ ID NO: 37801

SEQ ID NO: 118763 - DNA, 201 bp, Bos taurus; identical to SEQ ID NO: 37802

SEQ ID NO: 118764 - DNA, 201 bp, Bos taurus; identical to SEQ ID NO: 37803

SEQ ID NO: 118765 - DNA, 201 bp, Bos taurus; identical to SEQ ID NO: 37804

SEQ ID NO: 118766 - DNA, 201 bp, Bos taurus; identical to SEQ ID NO: 37805

SEQ ID NO: 118767 - DNA, 201 bp, Bos taurus; identical to SEQ ID NO: 37806

SEQ ID NO: 118768 - DNA, 201 bp, Bos taurus; identical to SEQ ID NO: 37807

SEQ ID NO: 118769 - DNA, 201 bp, Bos taurus; identical to SEQ ID NO: 37808

SEQ ID NO: 118770 - DNA, 201 bp, Bos taurus; identical to SEQ ID NO: 77559

SEQ ID NO: 118771 - DNA, 201 bp, Bos taurus; identical to SEQ ID NO: 37810

SEQ ID NO: 118772 - DNA, 201 bp, Bos taurus; identical to SEQ ID NO: 77560

SEQ ID NO: 118773 - DNA, 201 bp, Bos taurus; identical to SEQ ID NO: 77561

SEQ ID NO: 118774 - DNA, 201 bp, Bos taurus; identical to SEQ ID NO: 37812

SEQ ID NO: 118775 - DNA, 201 bp, Bos taurus; identical to SEQ ID NO: 37813

SEQ ID NO: 118776 - DNA, 201 bp, Bos taurus; identical to SEQ ID NO: 77562

SEQ ID NO: 118777 - DNA, 201 bp, Bos taurus; identical to SEQ ID NO: 77563

SEQ ID NO: 118778 - DNA, 201 bp, Bos taurus; identical to SEQ ID NO: 77564

SEQ ID NO: 118779 - DNA, 201 bp, Bos taurus; identical to SEQ ID NO: 77565

SEQ ID NO: 118780 - DNA, 201 bp, Bos taurus; identical to SEQ ID NO: 77566

SEQ ID NO: 118781 - DNA, 201 bp, Bos taurus; identical to SEQ ID NO: 77567

SEQ ID NO: 118782 - DNA, 201 bp, Bos taurus; identical to SEQ ID NO: 37814

SEQ ID NO: 118783 - DNA, 201 bp, Bos taurus; identical to SEQ ID NO: 37815

SEQ ID NO: 118784 - DNA, 201 bp, Bos taurus; identical to SEQ ID NO: 77568

SEQ ID NO: 118785 - DNA, 201 bp, Bos taurus; identical to SEQ ID NO: 37817

SEQ ID NO: 118786 - DNA, 201 bp, Bos taurus; identical to SEQ ID NO: 77570

SEQ ID NO: 118787 - DNA, 201 bp, Bos taurus; identical to SEQ ID NO: 77572

SEQ ID NO: 118788 - DNA, 201 bp, Bos taurus; identical to SEQ ID NO: 37822

SEQ ID NO: 118789 - DNA, 201 bp, Bos taurus; identical to SEQ ID NO: 77576

SEQ ID NO: 118790 - DNA, 201 bp, Bos taurus; identical to SEQ ID NO: 37823

SEQ ID NO: 118791 - DNA, 201 bp, Bos taurus; identical to SEQ ID NO: 37824

SEQ ID NO: 118792 - DNA, 201 bp, Bos taurus; identical to SEQ ID NO: 37825

SEQ ID NO: 118793 - DNA, 201 bp, Bos taurus; identical to SEQ ID NO: 37826

SEQ ID NO: 118794 - DNA, 201 bp, Bos taurus; identical to SEQ ID NO: 77578

SEQ ID NO: 118795 - DNA, 201 bp, Bos taurus; identical to SEQ ID NO: 37828

SEQ ID NO: 118796 - DNA, 201 bp, Bos taurus; identical to SEQ ID NO: 77579

SEQ ID NO: 118797 - DNA, 201 bp, Bos taurus; identical to SEQ ID NO: 77581

SEQ ID NO: 118798 - DNA, 201 bp, Bos taurus; identical to SEQ ID NO: 77582

SEQ ID NO: 118799 - DNA, 201 bp, Bos taurus; identical to SEQ ID NO: 77584

SEQ ID NO: 118800 - DNA, 201 bp, Bos taurus; identical to SEQ ID NO: 77585

SEQ ID NO: 118801 - DNA, 201 bp, Bos taurus; identical to SEQ ID NO: 77586

SEQ ID NO: 118802 - DNA, 201 bp, Bos taurus; identical to SEQ ID NO: 37831

SEQ ID NO: 118803 - DNA, 201 bp, Bos taurus; identical to SEQ ID NO: 37832

SEQ ID NO: 118804 - DNA, 201 bp, Bos taurus; identical to SEQ ID NO: 77587

SEQ ID NO: 118805 - DNA, 201 bp, Bos taurus; identical to SEQ ID NO: 37833

SEQ ID NO: 118806 - DNA, 201 bp, Bos taurus
gaggctggtatgaggagacaaaatgtgtacatgattcctcacctcaagggcagctagaaaaaggcataggaatttattagatgaaggcccaggtgggaaayaccaagctgactctaccttccctggaaatcacatatcctgaagatgcagtctggttaggaagaaagaatattgggcttgaggcctgaatatctgagtttg

SEQ ID NO: 118807 - DNA, 201 bp, Bos taurus
ttttaagatcttgccattctctaggagtgtgtacggaggacacccctaatgttaattagagcttgcttcattaacaacttaaccaaaaggccacactttgygaaattatttgggagcctacaaggaatgagagttgatgaaaagaaattaccatgagtatctttcccatcagttaatgaagaatatgatgtataaatcatt

SEQ ID NO: 118808 - DNA, 201 bp, Bos taurus
gttggaagatgaacacattcccctccctctgtgtgtgaggaggcaggagagacccaactatttaatatgttcacccaaaggacagtccaacaaatcatccyaaagtggccggcattagggaaacaagttcagcgtgcggttgctgatttttatgctatgatccatcttattaaaacagagacactaagattaacaaaccga

SEQ ID NO: 118809 - DNA, 201 bp, Bos taurus; identical to SEQ ID NO: 37838

SEQ ID NO: 118810 - DNA, 201 bp, Bos taurus
ggcctccctaaccgtcagcccatgtttctcttcctgtgagaatgctgaactctggccccatcgggcgtacagggaaggcagagccctaagctgtcaggccrgctgtacctgttccccatggggctgacaagatttggctaagcctgtgaagagagactcctcccgcccacccctgccagccggtaacaactgccaggtgcc

SEQ ID NO: 118811 - DNA, 201 bp, Bos taurus
cttcttgtgtcaggaattgaaaatgattcaatctaatgtgtgtagctcttgcccttgctgccagaaaccttagagctagcttctggcacctgtgccagtcrgtccaacgtaactgcttacttgtctacgcttcttgcatccttcagctgtgctctgcagggctttactatgaattatcttattttggactgtgtttcaatc

SEQ ID NO: 118812 - DNA, 201 bp, Bos taurus; identical to SEQ ID NO: 37842

SEQ ID NO: 118813 - DNA, 201 bp, Bos taurus; identical to SEQ ID NO: 77604

SEQ ID NO: 118814 - DNA, 201 bp, Bos taurus
actccttccccatctccttggcttttggatcatcaactggcccccttactcctggggatgaaaactcccagggttagctgctaaacccctttgagtctggyagacccctggtcactggccctccgtgatgacccactgagaggaactctctcccatccccaggaaggtgtaaactgtatgcgctcatggtctccaatcatg

SEQ ID NO: 118815 - DNA, 201 bp, Bos taurus; identical to SEQ ID NO: 37843

SEQ ID NO: 118816 - DNA, 201 bp, Bos taurus
gatatttatttcctatagagtacaactgtgaaataagtacgtatggaagccacgtgagagagacaagagctggggcctgtgaaatcagagaaatctgacarcaaaggttgctcacagtgaactgagtcacagtataaaggaaactggaccctccctttgtggccacaagtctaagggcaacgctgtcaccgttaacagtga

SEQ ID NO: 118817 - DNA, 201 bp, Bos taurus; identical to SEQ ID NO: 37848

SEQ ID NO: 118818 - DNA, 201 bp, Bos taurus; identical to SEQ ID NO: 37849

SEQ ID NO: 118819 - DNA, 201 bp, Bos taurus; identical to SEQ ID NO: 37850

SEQ ID NO: 118820 - DNA, 201 bp, Bos taurus; identical to SEQ ID NO: 37851

SEQ ID NO: 118821 - DNA, 201 bp, Bos taurus; identical to SEQ ID NO: 37852

SEQ ID NO: 118822 - DNA, 201 bp, Bos taurus; identical to SEQ ID NO: 37853

SEQ ID NO: 118823 - DNA, 201 bp, Bos taurus; identical to SEQ ID NO: 37854

SEQ ID NO: 118824 - DNA, 201 bp, Bos taurus
acactgagtagggggatgggggggtggaatgaattgagagattgggattgacacagatactttgtataaaatagataactaatgagaacttcccctgataraacagggaactcttctcaatgctctgtggtgacctaaatgggaaggaaatccaaaaaagaagggatctatgcttacatgcagctgattcactctgctgta

SEQ ID NO: 118825 - DNA, 201 bp, Bos taurus; identical to SEQ ID NO: 37855

SEQ ID NO: 118826 - DNA, 201 bp, Bos taurus; identical to SEQ ID NO: 37859

SEQ ID NO: 118827 - DNA, 201 bp, Bos taurus; identical to SEQ ID NO: 37860

SEQ ID NO: 118828 - DNA, 201 bp, Bos taurus; identical to SEQ ID NO: 77627

SEQ ID NO: 118829 - DNA, 201 bp, Bos taurus; identical to SEQ ID NO: 37862

SEQ ID NO: 118830 - DNA, 201 bp, Bos taurus; identical to SEQ ID NO: 37863

SEQ ID NO: 118831 - DNA, 201 bp, Bos taurus; identical to SEQ ID NO: 77631

SEQ ID NO: 118832 - DNA, 201 bp, Bos taurus; identical to SEQ ID NO: 37864

SEQ ID NO: 118833 - DNA, 201 bp, Bos taurus
cagtaacccagaccccagttttctaaatgggcaagcaaatgattttaaaagggaaacatacagtggttattatgaaatgttagtcgtccttttttgcctgycccctggcctctctctgtcctccctccctctttttctcatctctttgtataacgtatgtaaaattattaactgatcttagtataatcatttgggaagcaa

SEQ ID NO: 118834 - DNA, 201 bp, Bos taurus
ttgatctgatttctctttttaaaatttcaggtttatatattcatctgcctagtggacactttcactgtaagtgaaattcaacacatggtagagaatttgartgttggagtaagggagacataggttgccagctgtcccatttaattgtttagaaaccttgccgaagatatttaaactctatgtgactcagtgttcattctg

SEQ ID NO: 118835 - DNA, 201 bp, Bos taurus
ggggcctggaaactagtcctgccactagaattggtcatgaatttatgacattgaatgtaacaataagggaaggagggaggaacccagttgtctagaaagtrtttttggcctatttaggagccctttatcagcacattggcgcgcgggagcagtggggccatgctgcgggcctgggccatggctgccgccgatgctgaggtg

SEQ ID NO: 118836 - DNA, 201 bp, Bos taurus
cagggttgagggcagtgagtgtagcagtacattaatggaatcttttgaaggaggtcctcattatcttcattacctccaccatagtttggccccaggtaaayagtgaggagggaacatagcttcccccatcaacagaaaattgaattaaagatttaataagcagggccccgcccatcagaacaagacccagtttccccttca

SEQ ID NO: 118837 - DNA, 201 bp, Bos taurus
tattataatgttttaacagaatctctatttacttgttaaaaatgagtatttacttactaaaaatgagtatcacctatctttgtccttcttcattggctttrcttagtttactttgtccaggcaaaattcatacatgcaacttgaagtaaattgtttgacaaaaaaataccagaagaaagaaacttgaattactgattagat

SEQ ID NO: 118838 - DNA, 201 bp, Bos taurus
tcaaactagctgttgtgatttgtaagggaaaaatacactgcttgaatgaagcagaatacaagtacctgtactgacttgttgcctttaggcaaatttgattrctctaaccttgtataaagagctaggattatgtttttcttaaactttccaagaaggtagactgggaatatgtttctacatcttttgacatttaatgcatgt

SEQ ID NO: 118839 - DNA, 201 bp, Bos taurus; identical to SEQ ID NO: 37868

SEQ ID NO: 118840 - DNA, 201 bp, Bos taurus; identical to SEQ ID NO: 37869

SEQ ID NO: 118841 - DNA, 201 bp, Bos taurus; identical to SEQ ID NO: 37870

SEQ ID NO: 118842 - DNA, 201 bp, Bos taurus; identical to SEQ ID NO: 37871

SEQ ID NO: 118843 - DNA, 201 bp, Bos taurus; identical to SEQ ID NO: 37872

SEQ ID NO: 118844 - DNA, 201 bp, Bos taurus
atcagatcagattcagaagtactataaaaagtactaccccatttaaggaacaaacatagaaatatgacctagcattggacgctctgtaagaattggcagtrtctggatgaattactcaagagcagcactaagtgattacagataatagagaacaccttaataaattttgtcatcatgcccctaaatcagatacagctgaag

SEQ ID NO: 118845 - DNA, 201 bp, Bos taurus; identical to SEQ ID NO: 37873

SEQ ID NO: 118846 - DNA, 201 bp, Bos taurus
acccactcaagtattcttgggcttccctggtggctcagctggtaaagatccacctgcaatgtgggagacctgggttcaatccgtgggttgggaatatcccrtagagaagggaaaggctaattccatggactgtataatccatggtgtcgcaaagagtcagacaggactaagcaactttcactagtgatgggtattacagtt

SEQ ID NO: 118847 - DNA, 201 bp, Bos taurus
gaaaaaaaaatgagctatcttttctttctctctgcccatactcaacatctagtgaaaacaggaatgagaaaagagctatatgatctaaatcgcagatattrgaaaaaatattgtttataaaaacattgcaagagaatattattttaaaaattggggtttggcaaagcaatttatagattcaatgcaatccctatcaagcta

SEQ ID NO: 118848 - DNA, 201 bp, Bos taurus
acaaagaatcggacatgactaagcaactaagcacagcacagcattccacttatcaggatggatatatgctacttttgaagacaagaagtgaccttttatcrtccctgaggtatataaattggttattgcctattgcagtaaaaattccaagaaaaataattaaacaaattatgtataaaccactaactacatctatatgga

SEQ ID NO: 118849 - DNA, 201 bp, Bos taurus
attgctaagtttacaacatacacagaagtaaaatgtatgaagagtacaaaaaaatagaagaggcgaaataaaagtatatgattgtaaaattcttatactayatgtaacatcacttgaaagtagattgctacagtaaagatgcatagaagaacattggagccaacaccaaaataacaactttatactgatataataaaattt

SEQ ID NO: 118850 - DNA, 201 bp, Bos taurus
gataatttaacacttatcttaaaatctaattagcagttaatcttataaacttatcatttgaggataggggtagggcaagtcagattggatgaaatttaacmcaagcatgatgacttgaaattgaatcagctttagtttatgtatagtgagcttgctcattctgtcttttttccttaatacaggtgatcagtgggcatcttg

SEQ ID NO: 118851 - DNA, 201 bp, Bos taurus; identical to SEQ ID NO: 77644

SEQ ID NO: 118852 - DNA, 201 bp, Bos taurus; identical to SEQ ID NO: 37876

SEQ ID NO: 118853 - DNA, 201 bp, Bos taurus
aacacaaaaaaggtattgaggaagttaataactttaaactcatcttccaaaatcatatttaaagaaaattctgccatctgtggagcattatgataccgtcmttatgattttatattatttcattttatgcatgacatgtgtacagtgtgctcagtcgttttagtcatgtctgactctttacgaccctgtggatagtagcct

SEQ ID NO: 118854 - DNA, 201 bp, Bos taurus
tcggggtgtgctagcagtcactgccatgttgaggggcggggccaggtttggagaggctggagccacaatcctgagtgaggttatcatatccttggtgctayagagtttctgtcttggccaggggtagcgatgggacccacgaggctggaagaggagccttgagccagccctggcctttcccaaggtgcactggtgattctg

SEQ ID NO: 118855 - DNA, 201 bp, Bos taurus; identical to SEQ ID NO: 37878

SEQ ID NO: 118856 - DNA, 201 bp, Bos taurus; identical to SEQ ID NO: 37879

SEQ ID NO: 118857 - DNA, 201 bp, Bos taurus
agaactcggacggcatgtgctcgcctggcctgaggtcacttcagagccttttttcttcactaggtccacactctccaaggggactaccttgctctctgtgyaccaggacaggctccacagtgaacaccgacccacgacacatcctgggacgtgctgggtcacagccaccatcagcatctgtattttacaggcttataaacg

SEQ ID NO: 118858 - DNA, 201 bp, Bos taurus
aacagacatgccacattctctcctctcacgggggacccaacagacgcacccatgggcagcagtcatctcaccactctttttaggtggagctcatacaggcytaccacacaacgcagtccacggccaagcaagtgcctcgtgacacacatgcgcagtgctacaagtgatctcagctgttacataagcctcatgaaggcacag

SEQ ID NO: 118859 - DNA, 201 bp, Bos taurus; identical to SEQ ID NO: 37882

SEQ ID NO: 118860 - DNA, 201 bp, Bos taurus; identical to SEQ ID NO: 37885

SEQ ID NO: 118861 - DNA, 201 bp, Bos taurus; identical to SEQ ID NO: 37886

SEQ ID NO: 118862 - DNA, 201 bp, Bos taurus; identical to SEQ ID NO: 37887

SEQ ID NO: 118863 - DNA, 201 bp, Bos taurus; identical to SEQ ID NO: 37888

SEQ ID NO: 118864 - DNA, 201 bp, Bos taurus; identical to SEQ ID NO: 37889

SEQ ID NO: 118865 - DNA, 201 bp, Bos taurus; identical to SEQ ID NO: 77656

SEQ ID NO: 118866 - DNA, 201 bp, Bos taurus; identical to SEQ ID NO: 37891

SEQ ID NO: 118867 - DNA, 201 bp, Bos taurus
cacatttctttgtaaacctagtgaccaaccgactctcaagctcaggtctatctggacaaacagctgaggaaggatcactcaacaccagttttagttcattytctctgaataaactgagtcttggcttagcaaacattacacacgactccttaacatatggacagcaaggactaaattttcagcagggaaagctttccagtc

SEQ ID NO: 118868 - DNA, 201 bp, Bos taurus; identical to SEQ ID NO: 37892

SEQ ID NO: 118869 - DNA, 201 bp, Bos taurus; identical to SEQ ID NO: 37893

SEQ ID NO: 118870 - DNA, 201 bp, Bos taurus
gtcatgatatgtctcccaaatatgggctgaattttgggccaagagaggaaactgatcaatggaatatttcttgccatatcagtaaacaaggatgtcacagkcattaccgattgcaaccctcttatgtgacccagtgagccctcagggaactcaggaaggagaagaatccctgccatctagcagctattagactgcagccac

SEQ ID NO: 118871 - DNA, 201 bp, Bos taurus
aacacaagtgtgatttcagaattactaggagaaaattcttggaagaaaaagataacttacccttattaatttgaaaacgactctagaaagaaatagggagygacactttctgcctcttacttatctgcattttctattgtttctacagtcagaatgtatcacctgaggaaaacttaagtgtggtattttatatatgaattg

SEQ ID NO: 118872 - DNA, 201 bp, Bos taurus; identical to SEQ ID NO: 37896

SEQ ID NO: 118873 - DNA, 201 bp, Bos taurus; identical to SEQ ID NO: 77663

SEQ ID NO: 118874 - DNA, 201 bp, Bos taurus; identical to SEQ ID NO: 37901

SEQ ID NO: 118875 - DNA, 201 bp, Bos taurus; identical to SEQ ID NO: 37902

SEQ ID NO: 118876 - DNA, 201 bp, Bos taurus
aatgtgaggagcagggccaggtattttaatcaaccgtgtaatcaataaacatacattgattgaacaaccatttattccaaaatattaattaggtatctccrtgagtcaggccccaggccaggcactgggaatatatcaatgagtaagacacagacctaatgtaaggggcacacagcatagttggaaaatcagaggaggaaa

SEQ ID NO: 118877 - DNA, 201 bp, Bos taurus; identical to SEQ ID NO: 37904

SEQ ID NO: 118878 - DNA, 201 bp, Bos taurus
gaacttctggatgggagcttgtgccctgaggcaggggaaggcgtcctgaaacaagaggcattcctgtgcacaggggagcttccttgcaggcgggcccaacrgggagctgtggagtcttggaaaactgggcagagtagggaattaaagggcagaaaacagagcaagttgcacttctcagcccgtgaacagcttgcaaactat

SEQ ID NO: 118879 - DNA, 201 bp, Bos taurus; identical to SEQ ID NO: 37909

SEQ ID NO: 118880 - DNA, 201 bp, Bos taurus; identical to SEQ ID NO: 77672

SEQ ID NO: 118881 - DNA, 201 bp, Bos taurus; identical to SEQ ID NO: 77674

SEQ ID NO: 118882 - DNA, 201 bp, Bos taurus; identical to SEQ ID NO: 37912

SEQ ID NO: 118883 - DNA, 201 bp, Bos taurus; identical to SEQ ID NO: 77675

SEQ ID NO: 118884 - DNA, 201 bp, Bos taurus; identical to SEQ ID NO: 37914

SEQ ID NO: 118885 - DNA, 201 bp, Bos taurus; identical to SEQ ID NO: 77677

SEQ ID NO: 118886 - DNA, 201 bp, Bos taurus; identical to SEQ ID NO: 37917

SEQ ID NO: 118887 - DNA, 201 bp, Bos taurus; identical to SEQ ID NO: 37918

SEQ ID NO: 118888 - DNA, 201 bp, Bos taurus; identical to SEQ ID NO: 37919

SEQ ID NO: 118889 - DNA, 201 bp, Bos taurus; identical to SEQ ID NO: 37920

SEQ ID NO: 118890 - DNA, 201 bp, Bos taurus; identical to SEQ ID NO: 37923

SEQ ID NO: 118891 - DNA, 201 bp, Bos taurus; identical to SEQ ID NO: 37924

SEQ ID NO: 118892 - DNA, 201 bp, Bos taurus; identical to SEQ ID NO: 37925

SEQ ID NO: 118893 - DNA, 201 bp, Bos taurus; identical to SEQ ID NO: 37944

SEQ ID NO: 118894 - DNA, 201 bp, Bos taurus
ttacgtctcacgcttttcttctccacactctcggccagagggcagaagcaaaaatctgtgcttgcttctctcttctccatttcaaatatttttggtcatcrttttgacaagatggtggcctttgacttgtggacctgggaatgtggtttccttactctctttatggactagtcctgtaacagtaggtgccttgcattggcc

SEQ ID NO: 118895 - DNA, 201 bp, Bos taurus
ctcatccatctttctccctaaattctatttctctccctacttagtgtttaagcaggatagaatactattcaggcattctgtaggcaaccttctcttctcartctatgagctcttcttatctgacctcagataggcccatggctttaaataccatccaaatgtatatctccaactctgatctcgcctttggacttaggatgc

SEQ ID NO: 118896 - DNA, 201 bp, Bos taurus
gtgtagagtttagctttacttgtaatcatgttttccattctcatagaaggttttcagggtcgaatgttcatgttaaaagttggggagtggggtagttgtcrgggtgcagtgagcacaaacttagctttggaaggccctagagtgaccccggaagatgttaacatgttttctggaagcttagagcagggtgaaaataactga

SEQ ID NO: 118897 - DNA, 201 bp, Bos taurus
cagaaattttggccaactcctccagcagtgctgagtctggctgacaagcccctgagaatgcagctcacagagctgccccgtatgcattctagtttgctaamgcccggccgaccagagctgactgcacggctgctctggggctgtcctcttgtgacctctcagggggatgatcagcttcacctctctggatgctcctggagc

SEQ ID NO: 118898 - DNA, 201 bp, Bos taurus
tctaattcccatctaaagaggcagcatccgtcaaaagagagtggagccagcagctgtgctgtgcttgagttccctgtggctaaatagatggtgtgctgctrcactgagctaccatcttcaacaccagtgactttctttgctgctttcttccagctggcaccttgggagcttggcccaaggtaagcaggagtgattctgaag

SEQ ID NO: 118899 - DNA, 201 bp, Bos taurus
gggttgggaagaggccatcaaaggtaggatggtcagagaaagttcccctaagaaggtacagttctgggtaaagggagcagttactacaaggccccgaggtragtgtgggcttggctctcggaaggggcagcaggaagagaggcggctggaggggcggcagggggagaacctacagagcctggaggagactcgctagggctg

SEQ ID NO: 118900 - DNA, 201 bp, Bos taurus
aggattccccatgctgcagagcaaccatgcccatgtgtcacaagtactgaagcctgtgagccctagagcctgagccccgcaacaaaagcggtcacggccaygagaagcttgggcaccgcgactggagagcggctgggtgtggctgtgttaaaaagctctacttatacaaacagctagcagatttgacttggcctgtgggca

SEQ ID NO: 118901 - DNA, 201 bp, Bos taurus
aaaaagaaatcatgtttctcttccacttgaacaaccaaaaaaccgtacaaaatatatgagaccataattttttcaccagagatgatccttgagacccagamgataaaaaggtgggccttgtgcttgcctccatttactgatttgtgagaaattccaggttgtgggtcaggaagggcaaacctatgtggagcctggcaaact

SEQ ID NO: 118902 - DNA, 201 bp, Bos taurus
cctgctgggctcatcccctcccaagtactgaagcgatttaatttgtgcttgtcttcaggatgtaactgcgaagcaaccacacatgtggtgtctagtaattrttcagcaacctttgctcagtggggcaaaggtgatgtggcgtactgagaactgtgcttggaatctattttagccgagtgatagagcttgctgaaggctttt

SEQ ID NO: 118903 - DNA, 201 bp, Bos taurus
tagcaggggatgcgtagagaatatgacataatcctcaatctgagaactttcaatattagctgtggagactaggaattgatataaaacaataccaaaaagaycacgtagcaaagttttacaggtgataaaaacctaatgaaagtcaggaaggaaacaggttagtgttggaaatggagcacttaataaatgggatagaatagg

SEQ ID NO: 118904 - DNA, 201 bp, Bos taurus
agcccatggcttttcactggctgagtccttgccaggaaaggagaggagtctttcttcttcgttttggttctgttatggtcacagggtgtcagaactcccaytctggtctcccaactctgtttaactgagatttctgtttattaattttttatgcttctaagaattgaagtctggttaagaggatgggagaattttggttaa

SEQ ID NO: 118905 - DNA, 201 bp, Bos taurus
gacccagggatcaaacctggatctcctgcattgcaggcagattctttactgcctgagctaccagggaaatccattcgtactataatcccttttaaagataygaaatatcttttaagatttatatcatgaaatatactagtgatatgaaaaattatatagtgcaagcacagtttcttgatttaaataatagaaacaattttg

SEQ ID NO: 118906 - DNA, 201 bp, Bos taurus
cttgacttcacattccaagatgtctggctctaggtcagtgatcacaccatcatgattatctgacatgtatttgtaaattaaaccacattgagggattattsagaagggcttttgggccaactgttttgaaaggaagaagtctttttgcttaatcctatgacatgtgcaaagttatttttgtgaatttcacttattaaaatt

SEQ ID NO: 118907 - DNA, 201 bp, Bos taurus
gactaactggtacacatagcatcagcagacatctgtcaaactttggcttttctgttactcattctttcaaacaaaaacaaaacccagtctccagtctgagyattttgcagtgtttagttaatatgaaatatgtagtaaactgtaatatgaagctgttggatgaaaattctgatcaatgtagaaaacaaaggccatttattg

SEQ ID NO: 118908 - DNA, 201 bp, Bos taurus
ttcagactacatccatggtcctcattctacttcctgtttagctttgggccaaagactgcattcaaaacaggcaggtgacaaatatacccatagtgacctcyaaacgactaaaatggtaaaaggggcacagagagtccaaggctcctgatcaccctccccagacactcaaccataggcccctgggctccaagaagggatctg

SEQ ID NO: 118909 - DNA, 201 bp, Bos taurus
atacagacactatttaaactgtgttacaaaagcaacaggtaccttaattggagataatcaaggatgcaatatgtggggttagcttatctcaattttgtgamgttgttggaaaaatgcttttcctgcaatctttctttattggaattttcctgaaattgcaatgggagctctgcaaaacctgttatttacaactgtgtatct

SEQ ID NO: 118910 - DNA, 201 bp, Bos taurus
tggtgttttcaggtgtctttgacatgagtggctaaaacagaatcacttctacaaagatgcctctggcaagctctgtattcatttcactgcacttcaaatcraggggccggtaaagtgaaacagagacgctcaacagcgatggcagacgtggctgagtgactcctcccagaaagcaggcttatctccatggggatctttctg

SEQ ID NO: 118911 - DNA, 201 bp, Bos taurus
gtggggttgcaaagagatggacatgaatgagcaactgaacaacaaatcatttaggaaaaaatgtatttcccataaaggagaattatttctgcagaagtttkaaacttgctttagttactaagagactcttttaggagaatgttttataagtgtgtctaacttgacaaaataaaaaaagaaatgtacaaatctttagaggag

SEQ ID NO: 118912 - DNA, 201 bp, Bos taurus
gttcactgtgctaaatgattgtcccatttagcacttatttgctagcttgatttcttgtttctggactaattatttttctttaaaggggcactggcaaatakaagaggctgttagtctaaacatttactgtgggttctattatcttctctttctatttcactaacaacaaatacaacattgacttaaacaacagcaaacggc

SEQ ID NO: 118913 - DNA, 201 bp, Bos taurus
acaggggccaaagtcatgtgcgttattactattgctgttggcatttattacctgctgtgctgatacagaaaagagggcgcatctttggccaagcaccgccmactatgctaatctatgctaatttcacaacaaccatcagcacagcacagggcaacagagcttcttgcttagccatccatccatgcatgcatgacatgaagg

SEQ ID NO: 118914 - DNA, 201 bp, Bos taurus
ggccagagaaataggcttgggaatgggcaaggctgaaatcagccccagaggctaagaattgggaagcccagcaattgtggtttatcagagccaggctggtrgaagctggccactggtttggcactggagaccaactgtttactattttctctgcaccggatgcaaatatttcaccttgaatagcaaaacaaaaggcccttg

SEQ ID NO: 118915 - DNA, 201 bp, Bos taurus
tgacttggcctctgttctccaggtgtgagtgacgcacggcattgctctagggcacagccactgactattctgaagtccctgctttggccccaagcctgccytgtgccatgccacggaatggtagccacatctctgcataccagtcagcagaccactctgttgcttgtcctgtgtctgtttgccctcctaggtggccttttc

SEQ ID NO: 118916 - DNA, 201 bp, Bos taurus
ctgatagaacactgatgatatgtgaccctcatcctcaaggtgctcacgttcatggtacatgaatattaaaatacagttcaaagatgaggggcctttttttkgggaggaatggatataaaaatggaatgaatgtggagcattgtacatttccttcatcttagaaaggaaattaaaaggccttcatcttagaaaggccttaaa

SEQ ID NO: 118917 - DNA, 201 bp, Bos taurus
taactaacacctaactgtattataaaagtatgaaacagcttccttggacggggtaatgggaaaaggtactgattaagcaactttgcaaatgagctgaattmataaaactaaagttaaaaaatatcatgtataagctctgcatgaagttgtttctcacctggggacaggttacagtttgggtgttgctttacaagtatactg

SEQ ID NO: 118918 - DNA, 201 bp, Bos taurus
agaagcacggtttccacacaggccattaaatgtgaccttacttgggcttgtacccttgctgttcttcttaattttcagttgctgaaggtggaaaatcactyactaacgtggtgccttctacggttttctgaggaattagcaagacctggactgggcagttttttaggaacattacacataaaaagcgttctagattttttg

SEQ ID NO: 118919 - DNA, 201 bp, Bos taurus
agattaaaatacccttctctgtacctagtaagattatgcacaaaaataaagactgttattctgttccattttaaacaggtttatatgtccttgaaatagaytgagtttcagttaggaaagtttgatgcttataatttatttatattatgtaggaatattaaattttagtctcatatacatttaacttccctatgggaaagt

SEQ ID NO: 118920 - DNA, 201 bp, Bos taurus
gaatcgtaggctttgtgataactgagaattatattcagaacttgaaacagcgatggaaaaaagagaccagttgttggccgtaaacaccttctgagtatgcrtctctaaaaacagctactagggaaaaggtctgggacctgtgattccaggtctctggaggtgggtgagtgggcaggtgctggaggccctccagactaattt

SEQ ID NO: 118921 - DNA, 201 bp, Bos taurus
tggaggctagaaacaggaatagcggcacaggtgagttaaatttgaaaaatgtatagaacctcaattagtctctgtaaggaggaaagaaaatctgtgcaaargaatatttgttgcaatacagaaaaaaagccttacatcttcttacatggaaatttttctttaaagaatccctcactcattaaattgttacaaaatggaacc

SEQ ID NO: 118922 - DNA, 201 bp, Bos taurus
actagtcaacccaagatgtgtggaaattggtcaaagccctctgtggctctcttgatgcccagggtttcctttcccgttgcattcatgagtagtccacttgytctggggagtggcccaaatggaagtgcagcctgaggccagctgtgaggattgctgggagcatttgtttgtgtgacaacccactccagtattcttgcctgg

SEQ ID NO: 118923 - DNA, 201 bp, Bos taurus
ttatgaataggaggtctttatgtattttgtgattagagtatcatagtgttgccatataatctcattgcaaaacttctgataacctgtgtaggccaatatargtaaacatagtttggcttgaggattagattagtgaaagttaaagtggctcagtcatgtctgactcattttgaccccatagactgtgtagtccatggaatt

SEQ ID NO: 118924 - DNA, 201 bp, Bos taurus
tgggtcattgtgaggctcaaacgagctctttcatgcagatttcacaggacacagtgaacacgtaaagtgttacctctcagtgactagcactactgtgaatrttacacctcaccatgagccagtcatcttgtccctcccaaacaggctcttccacccctcccacagagtagcctttaacattctcacagtctagctcagtgc

SEQ ID NO: 118925 - DNA, 201 bp, Bos taurus
gccttcagggcctgcttgagcataacctcatagatactacttccacttgaaggaggagtgttggtgtgcatgcccaggcttatggcttgatgggtcccacmtcattcagttcatcacggccagttcaggttacatagtaactcggtggccaatggtacaacattcaactgccaagtccagtatgaaaccaaaaggtttttt

SEQ ID NO: 118926 - DNA, 201 bp, Bos taurus
ctggagtttcagctagggttaggttgaggtattgatgaaacatgaattggcagaagtttctttttttatggagactggctgatgatacatggggatctttyagactcttctggccactttatttgaaatttcctctgaaaatgtttttaaaaagaaattcctttcagtaccttgactataacacatgggtcagcaaattat

SEQ ID NO: 118927 - DNA, 201 bp, Bos taurus
ttccattaattctcgagccaggcttttatgactcaggggaggcctgggagagtacagcttttccacaaacaagaggtaagcagcagacacgatggggaggrgtctgtcccaggaaggccaatagggtcctccttggttacacgggtactaagatcttgggcaccaagcagcacatggctcctctactcatgttctattggt

SEQ ID NO: 118928 - DNA, 201 bp, Bos taurus
agggctgcattcattggtctagagtgtgactcacagctaactcagcttgtcggttcagttcaggtccatatggttggaggactgagatccttgtgtatttkatggccatccccctgcactggtctctactgttagaagctgcccacatttgtgctcatattttccatgtggcctcctccaatagccaacttgcatgcaggg

SEQ ID NO: 118929 - DNA, 201 bp, Bos taurus
aaaggtgcaaatagaataaatggttattgttaaagtagaaaacaaattaatagagaaggagtaataaagcttacatgcgcaaatcagggcaatagattcayaatgtgcaaaggaatttctcatgacattccagcctctgagtcagagaaatactgaaaggggtaagcctggagatttggaaaaagaatttctgaaggctat

SEQ ID NO: 118930 - DNA, 201 bp, Bos taurus
ttatgctggagtaacagggaacctgttttctatctgtatcttccctttggcaatatgaatgtctgacctttggccttttttaaaagaaaattttttggccrtgccacagggctcttagctctctgaccaggaatcaaatcagctccccctgcactggaagtgcagagctaaccactggaccaccagggagtgcctggcctt

SEQ ID NO: 118931 - DNA, 201 bp, Bos taurus
cagggaattccctgccatttccaagaacacaaaggaagtagtaccttaggagttggtccagagtactttattgagctggttatactctgacagtcctgccygtttcccaccagtgagtgcgtattttacacttgtgttctcactggggcactaaacagcttcagatgttcccccagcagttggtgtcttggccttggtacc

SEQ ID NO: 118932 - DNA, 201 bp, Bos taurus
gtagcaggcattatgtcgggctgccagaattaaataggaaaaaaaattttaattctaattgtgctacactctgtggcctggtccatgcacttgaaagtgayatgtgcccaaggaaagatgaaggcatcaggtattgagccaacaatgattccagaaagcaccctaaatcataaagaataatgacttggaaggcttaaaggc

SEQ ID NO: 118933 - DNA, 201 bp, Bos taurus
tccagggcgaatgcctgatctccagtgccattaggtataaaggtgtcctgggaacaatcatcactctggcaaaaacagaagggccagtgaaactctacagygggctgcctgctggtctccagagacaaataagcttcgcctctcttaggatcggcctctatgatactgtccaggagttcttcaccacagggaaagaaggta

SEQ ID NO: 118934 - DNA, 201 bp, Bos taurus
gttgctgtctgaagcatgtgttctccctcactgggcatttgcgtcttgcacaattgacgtggtaagataaaactttcacattttgagtgaggggtgttctmattgcctctgtatagctgtctgtatacaactcacagatgatgtccattaagttgatcctggatatttgggttcatgttaaaacatcgactggaaaagaat

SEQ ID NO: 118935 - DNA, 201 bp, Bos taurus
tatcttgaatcctattttgctatggaggcctcagaataaggatttcagcctgaaggcagccccacaaactgaatccccatggacgcagcctcaagaaagckatgaaaggcccatgctttgggcatcgatctatgggctacctggtttctacaggtagatgtcaaaaactggagactctgagatttcaccttattcgcaagt

SEQ ID NO: 118936 - DNA, 201 bp, Bos taurus
tgaagctttgttccagaatttgtctggttgggcccatgtgtttcagtaccaaccactgcaatacagttataatagaagcagttcttgaaggtggttaacamatatctaactttttggcccatccctggaatgtccaacacctttgggtactgagctgcatgtagaatttcactgtgtctaggattagggatagtctgtcag

SEQ ID NO: 118937 - DNA, 201 bp, Bos taurus
gtggtcactctggaccacctaatgaagaaactcaaacctaggttagaaaatttggactctgatgaactaaagagtccctgagaaatcttttacatcttctrtttcctcaaccagaaaattatttccaacagctgcactctggaggcatagtatgtaaattaactagtgggtttgctcattattttacaccctatagcccca

SEQ ID NO: 118938 - DNA, 201 bp, Bos taurus; identical to SEQ ID NO: 37947

SEQ ID NO: 118939 - DNA, 201 bp, Bos taurus
agcagggctgtcagtgagcaggcgggagttcaaggccgcctgccgccttcgcgcggagaatttcattaggcgccgaagcaatgttccgatatccgcgggaytcaggtgcccaaggcccgcgtccagaagatcacaggggggccgcctggtggcattgaacccaggagctggtactagatggcctctctcatgagagtatat

SEQ ID NO: 118940 - DNA, 201 bp, Bos taurus; identical to SEQ ID NO: 37950

SEQ ID NO: 118941 - DNA, 201 bp, Bos taurus
cttctgcattgggagcatggagtcttagccactggaccaccagggaagtccctgaaaccaattttgaaacacaaacttgaggagccatttctccaccagckaagaatctcatagacacaaaactcaaaaacactaaaggcaaagtctaagagactggcatgtgaggaacagtagctgctttgtagcctaaacacagaagtc

SEQ ID NO: 118942 - DNA, 201 bp, Bos taurus
aaataacagtgactatagtcggatgtgaaaagagtcagaaactcagaataaccagggttcaggggctagtaagattgttgggttggattcaaggttggatrttacaggtggtgatccaagtagacacagggagtgtggaatggaggtcctgctgttggggtgccgaaaattaggcagaaggcattaccaactttcatgtaa

SEQ ID NO: 118943 - DNA, 201 bp, Bos taurus
aagagtcattcttctcttattcttgacttaaatggaaatgctgttacaatttttctagtaagtgtggtggtgtttgtgtagattcttaaaatttacaatarggataatatctttttattttgtataattgttacaagggtcaaatgctctaatagattaaaatgttatgtaaatgttaaaagctatgccacagttacctgg

SEQ ID NO: 118944 - DNA, 201 bp, Bos taurus
caggaatgaccttatctttggtggatcagtgctctgcatgtcctgtctactggatcttgtcattcagataaatgagcttccttttgttgcggaagggggaycacttccagggcccgaaactgggctcttgtctaacacttggaaatgaattgtccaaggagacacatttgctgacaaagcaaaagattttattgggaaagg

SEQ ID NO: 118945 - DNA, 201 bp, Bos taurus; identical to SEQ ID NO: 37955

SEQ ID NO: 118946 - DNA, 201 bp, Bos taurus; identical to SEQ ID NO: 37957

SEQ ID NO: 118947 - DNA, 201 bp, Bos taurus; identical to SEQ ID NO: 37958

SEQ ID NO: 118948 - DNA, 201 bp, Bos taurus
tatcatgctgtatgttggcagaaatataggtgttttgtagcttgcacttaaatggctcactttgtaaaataggaaaaatgaatgaccagcagatgtgacakaagccttaaaaaattctactcagcagtcaactttagctacaaaatttgacaagcttgggcaatactaggttttagacagtgagtctataatttgcacata

SEQ ID NO: 118949 - DNA, 201 bp, Bos taurus
aaagcgttttctatcatcaccaggggccaaatggggacaatgcatttaggggaggaaaaaaaaatctgactttcccagatgttcttaatttagggtgaacrtgggcccatttcctgaggcagtatcagtttaggcttcttatcccaggaactatagaaagtgccttcttcagtccccggagtatccggtaatgggcaatac

SEQ ID NO: 118950 - DNA, 201 bp, Bos taurus; identical to SEQ ID NO: 37963

SEQ ID NO: 118951 - DNA, 201 bp, Bos taurus; identical to SEQ ID NO: 37964

SEQ ID NO: 118952 - DNA, 201 bp, Bos taurus; identical to SEQ ID NO: 37965

SEQ ID NO: 118953 - DNA, 201 bp, Bos taurus; identical to SEQ ID NO: 37966

SEQ ID NO: 118954 - DNA, 201 bp, Bos taurus; identical to SEQ ID NO: 37967

SEQ ID NO: 118955 - DNA, 201 bp, Bos taurus
ttttacagaagcattggaaacatcgaggggaaaaataatccatatccaagaggtttatttttctgaggactagtctctggcctctccatattgaaaagaaycacctatgatcatcctgccaccgggtgactggctggtttccttggacatagagccctgttagtgagtcggtgttggcctttgctgttgactggtggatgc

SEQ ID NO: 118956 - DNA, 201 bp, Bos taurus; identical to SEQ ID NO: 37970

SEQ ID NO: 118957 - DNA, 201 bp, Bos taurus; identical to SEQ ID NO: 37971

SEQ ID NO: 118958 - DNA, 201 bp, Bos taurus
tgtgattggtcagtggccaggtacctaagtatgacccatgtgagaaaggcaatccatcatatttcagggcattgataagaccagagattgtagcataattkaccaatggcctaggaccagtaaaaatattctcttggtattcacagtgttagcagctggtaatgattaaggcaccttcaaaagccattatgccttgtacat

SEQ ID NO: 118959 - DNA, 201 bp, Bos taurus
ttgtctttttatcaacaggataatttatatacactttccaggaggaagttatttcctcaggcaaataaacacctaactggatggaagaaacatcccagggyggcctcaagttgctggacatgggatatgtacatgcatgctaagtcttttcagtcatgtctgactatttgctaccccatggactgtagccctccaggctcc

SEQ ID NO: 118960 - DNA, 201 bp, Bos taurus; identical to SEQ ID NO: 37975

SEQ ID NO: 118961 - DNA, 201 bp, Bos taurus; identical to SEQ ID NO: 37976

SEQ ID NO: 118962 - DNA, 201 bp, Bos taurus; identical to SEQ ID NO: 37977

SEQ ID NO: 118963 - DNA, 201 bp, Bos taurus
gggtaatttacaacatttaattataagttggttaaaaaaaagcattttcatgtctgattataaatttccttcttatatttaaaatattaatattttctgayactaaaataatcactgaaaattttgacccctgtggtttaataacaacataattttcatctataaatacatatttgtatttctttttcataaatttgtgtt

SEQ ID NO: 118964 - DNA, 201 bp, Bos taurus
cactaaggaaccctcataaagtgaggactctgctttggtgaacaaatcatgaatagatcagcaaagaggtttttgttttttttttttaatagataagatayagtgaatataatgtaaagcaatgcatttcaaatatctttaaaaggaaactatcttaatatcacaaaagaatgatgataatgagattcttatgtatatttg

SEQ ID NO: 118965 - DNA, 201 bp, Bos taurus; identical to SEQ ID NO: 37978

SEQ ID NO: 118966 - DNA, 201 bp, Bos taurus; identical to SEQ ID NO: 37979

SEQ ID NO: 118967 - DNA, 201 bp, Bos taurus
tcttctgataggcatttatgtgatacataaatattttcaccttctcctaagaaaataatccatatacttctctagagtttttagggccaactttcatcaayatcatcaaatctaaatatttcctgttagccactctctgtgaggcaatgtagatccataaattaggccatctgtcttttcacaagaaaaggataaccaaac

SEQ ID NO: 118968 - DNA, 201 bp, Bos taurus; identical to SEQ ID NO: 37981

SEQ ID NO: 118969 - DNA, 201 bp, Bos taurus
aaaataaggccatttgattcaacaggacttcaaagataagtgggtaaagatgcaaattaatttaatggataaaccactaaagggctgattaggagcttttyagttgattgcaagataaatccaaaaactaagggtgaaagggaaacacagagacagcaggtcgtttgttttgttttgttttgtgaaagattcttgaaaata

SEQ ID NO: 118970 - DNA, 201 bp, Bos taurus; identical to SEQ ID NO: 37985

SEQ ID NO: 118971 - DNA, 201 bp, Bos taurus
cctttttatagaataaataaacatttgtctattttctagaacaggggtctgcaaattatgacccatggttcaaagttggcctgtggactctactttaattrtacatttgattaactaggaatagttttcatatatttaagagttgttaaataaagtcaaagaagaatgtgtgacaggattatatatggcctccaaaaccta

SEQ ID NO: 118972 - DNA, 201 bp, Bos taurus; identical to SEQ ID NO: 37986

SEQ ID NO: 118973 - DNA, 201 bp, Bos taurus; identical to SEQ ID NO: 37987

SEQ ID NO: 118974 - DNA, 201 bp, Bos taurus; identical to SEQ ID NO: 77742

SEQ ID NO: 118975 - DNA, 201 bp, Bos taurus; identical to SEQ ID NO: 77743

SEQ ID NO: 118976 - DNA, 201 bp, Bos taurus
ttgtaatttagactgtctagatttcaattacttaaacttttattatattgcaggagcagaaatgatcaagaacttgaatgcaacacattaacattttttcmataaaattctatagatgcagcttcctaaatcactttagagaattctttcatagtaagactttataaaatcattattgtatctaatttttcatacttttaa

SEQ ID NO: 118977 - DNA, 201 bp, Bos taurus
cattacaagttcagctgtgcagtgtgtgaagtagatgagctactcagtaggcctagtcttaacacacagacagagcagtctgagattcatcagtaagttcyaggtctaactgtctgttacagtggcccttctgttactctacatttaaagagaatatcaaataaggtccacattcatatttaaattggagaaggaaatggc

SEQ ID NO: 118978 - DNA, 201 bp, Bos taurus; identical to SEQ ID NO: 77745

SEQ ID NO: 118979 - DNA, 201 bp, Bos taurus
ggctaatttaaataagtttattggtccctggggcacagggtctgtctcctgttgtcccgtatttgacccttctggtgattacagcagtggtatcctggccrgagtatgaaactgcagtaatggaggaggttaaagtatagattaaataaactgctcaagggcatggactggcctcaggccaggaccttaaaattaatactt

SEQ ID NO: 118980 - DNA, 201 bp, Bos taurus
gtcatggtttttggtgatagaagaaaaatgatatgggattctgttcagaacatcttcattgaaagaaatgtcttggccatttatcaagagagtgcaaatawatatagattcatatggtctaaataaaaaataagatatttaattattttttactaagaaaccaactattaatacaaattatattagataaaggaaacatag

SEQ ID NO: 118981 - DNA, 201 bp, Bos taurus
caacttcagagaagattataccatgaatctatgaaacaaccaaacaatgcaattttattgtcttaaagatatttttcttattaaataatactgaatgaacmtgaacctctactcaattatccacttttatttctctcatcatttccctcttccatatctgaggaggtgaaatccactcctaccatatactttcagccaaaa

SEQ ID NO: 118982 - DNA, 201 bp, Bos taurus
atgaatttcagcagaaaatcatattagcctattatagctcctaataaatgatgtcataaaatcaaatccatggctatactgtggatctaaaaatcaaaacrataggttatagaatataacataatagggtatgtccatggcctcagaatttttttaaaaaaggtctataagaaaaagcccaacagaaacatgtgtaagaga

SEQ ID NO: 118983 - DNA, 201 bp, Bos taurus
tatttatcccattactgtataagccagcattaagatttatgataggtgaaagcacagatgatggcattaggctctcatgattcgatccaattggtcaggtrttagaacacactcaagctagagttgttttgagaaaattaaatgggatcaccacttcaaacccaataggatgttgacccaaaatatgctggtggcacctgt

SEQ ID NO: 118984 - DNA, 201 bp, Bos taurus
tggaatatcaattttgctagtctttaaaaattctgaaaaaaaagatcacagagttttagctgagtagttaaaataaactaattgattctttaaacaaaaaytgatttaccgcctatcacctttcaaagaaatggaagcctggggagagagcaatggacaaaggagacagaaattcctatctactttaaagatgaagagatt

SEQ ID NO: 118985 - DNA, 201 bp, Bos taurus
aattcagtgtgttccctccccttaaagcagacccactgaagtgtttaaaaaagagatcctactctcacaaattaaatcctcatctttctagggaagagagmttgatggtcaaatatttttcagtaacttcttgaaaaatttgtttaaaaatggccttcatattgagagattattgatgatttattaaaagttcacatgctt

SEQ ID NO: 118986 - DNA, 201 bp, Bos taurus; identical to SEQ ID NO: 77748

SEQ ID NO: 118987 - DNA, 201 bp, Bos taurus; identical to SEQ ID NO: 77749

SEQ ID NO: 118988 - DNA, 201 bp, Bos taurus
cgggatattcaaagtagtttcaatatggcctaaaatatctgcttacatgggttaccttgaaaacaactggattgtaaaaatctgagtttggcactggaagrctcccaagaaaatgggccccagccaactacaaagtaaacacagtggcagtatacagggatcaccactgactcatttatgtaacaggtggatcatgtttcc

SEQ ID NO: 118989 - DNA, 201 bp, Bos taurus; identical to SEQ ID NO: 77751

SEQ ID NO: 118990 - DNA, 201 bp, Bos taurus; identical to SEQ ID NO: 77753

SEQ ID NO: 118991 - DNA, 201 bp, Bos taurus; identical to SEQ ID NO: 77754

SEQ ID NO: 118992 - DNA, 201 bp, Bos taurus
aacatgaagtaggaaaatatgaattttagaatgccttctagttttatataaacttttattcaaatagagattaatctcactattcaggagtaatgatcacrttgacactgtgaccaaactaaaagggcactcagaggtagataacattttcctttctaaatgtcttttcttcatgattacatcagaaacttcacatttcat

SEQ ID NO: 118993 - DNA, 201 bp, Bos taurus; identical to SEQ ID NO: 77755

SEQ ID NO: 118994 - DNA, 201 bp, Bos taurus
atctggtccatctgctggacagccagtaatatccagattttctgaatacttctattgatggatacttgacctattttttttttttttaattttggcctttyaaaaatatctctacttgcacatcaaaatacaaaacccaatatttctttctataaaaggtagacaacttagaaaatatttatttatttaattggccatgcc

SEQ ID NO: 118995 - DNA, 201 bp, Bos taurus
ttttttttttccttatccaagctactactctggagtccagaatcactccactattactgttgctacagaaactcccagaaaattccaggtactgccaatarttgcaatgtcattgaagcccaaaacaggaagttttttccaatttatagccttttgattctctaacaatatcccctacgatagacataggagcaagccagc

SEQ ID NO: 118996 - DNA, 201 bp, Bos taurus; identical to SEQ ID NO: 77761

SEQ ID NO: 118997 - DNA, 201 bp, Bos taurus
tgcctaaatctttttgtcacccaggttattaacctaagaagctattattcatttactcttaagaagtcatctttaatttaaagcatttgtctatcttctcratcttttcccggggtaggattgtctactgaatttcactagaatcagatttcaatgtctccagacaatttctgaagcatcttagatatataacatccaaag

SEQ ID NO: 118998 - DNA, 201 bp, Bos taurus
taaataactgtgctccctgttgctggtattttatcaagctctgtttgttataactgcgcattatgttccatacaagacagcgtctttgagctctcttttcrtattttcctactacagtttaactccgtgaggagcaataccaatgtgccaccaggatggagaagaaatagcaggacccgctgctattaaatactcccacct

SEQ ID NO: 118999 - DNA, 201 bp, Bos taurus
gaagcatacatttagaacctgactggataagagaaaagtaatggaaacagggagataaatataggttgtagtagtcagaaaatgcctcctaagacttgagytgcacaagaaaagaaaatatatatgttgaatataactatcttggatagtttattctggatgtttgttttgtctacttcaatttcaagatttttgagaaca

SEQ ID NO: 119000 - DNA, 201 bp, Bos taurus; identical to SEQ ID NO: 77764

SEQ ID NO: 119001 - DNA, 201 bp, Bos taurus; identical to SEQ ID NO: 77765

SEQ ID NO: 119002 - DNA, 201 bp, Bos taurus
aggcagcttatagctgcagagaaagctcacgttacaaagacttcattacttttacaaaatatgcacccaaggacatttactagtgtattgagagctattaycataaataattaaaactaaactattcttctctaaataaatgtataaagtacattgggtgattccaagcactaagctttctcaacatactgctttgtagac

SEQ ID NO: 119003 - DNA, 201 bp, Bos taurus
ttttggaattttaggtgatcaaactgttagatgccagtgagtaagttctggagttgggggaccagcccttatctgccttatgctaaacatgcatttgcctstaaaaaatactcgagagagatcacttagtgtagatgaggaatatacatttttcaatttccccttgaaagcactaattctagcagaaccagtttataggac

SEQ ID NO: 119004 - DNA, 201 bp, Bos taurus
ttggatataaaaacctttggctacagagctatgctgaagttctctaatgcaaagcaaacaggtatagtactaatcattctctgtatacgtaattcactgcytccacagctgctatggcttcctcttggagaaagtatcttattctttcttattatcagttcctagtattaagcattcaataaagattagctgtatggaatg

SEQ ID NO: 119005 - DNA, 201 bp, Bos taurus
tgtaggttgtggcctcgaacccaagtatcttggcttggaagaggtattcttccagttttaccatgctgccttccctctaaaagtcctgggagttcctagarccaaatataaaaaagactattagttggatttcatttaatcacttttatatatggtttgatttgttcccaggtccattataaccatatttggaataaatta

SEQ ID NO: 119006 - DNA, 201 bp, Bos taurus
acaacaaaagcccttcccattagctgttggtttcacttataagcaattaccaggactctggcagcaagtcatttggggccctcttgacaagattcagacaygatctacagaaggtagggagaaatctcctcatctctgcatgttaattaaggaagacagatggccctgtgattattcaaccatatgtaggtcaagactaaa

SEQ ID NO: 119007 - DNA, 201 bp, Bos taurus
tgatgaccttaataatgacattaaaataatattttttgcttctcaatctatcaaagaaaagatttataataaccagtgttggtaaggacgtagaaaagcasatgctattagtaaaagggtaaactttacaaccattctagagtatgttaattgggaatatattttcacttagaacttcaacttctaggaatttatgttagg

SEQ ID NO: 119008 - DNA, 201 bp, Bos taurus
tatattgaacatcttttgatatgttatacatatatatatgtatgtgtatataaagacttaagacttcaacacattgaaaaaattttactcaaatgtatatraaataaattttgaaatacaaaatgggcttcaattagacattactttaaaaaataatctatttgtaggcataacatgaagttgacatcacagtaccccacc

SEQ ID NO: 119009 - DNA, 201 bp, Bos taurus; identical to SEQ ID NO: 77769

SEQ ID NO: 119010 - DNA, 201 bp, Bos taurus
aaagcagagtaattcaaaccccgcatctactgcttgccggcgccgccatgttgcctcctctcgggaagcgagcggggccacgtgaccaccaatcctcagcygcaattggtggcagctcaggttgccagggagacggggaagcttcttggagagaactgagatccacagaaaggagccaatgaactaaaatttctaggacat

SEQ ID NO: 119011 - DNA, 201 bp, Bos taurus; identical to SEQ ID NO: 77771

SEQ ID NO: 119012 - DNA, 201 bp, Bos taurus
ctctgaagatttggaatttaaacaatatcctttcaatgtaatttaaataaattcttagggggtaccagagattaaggaatggttgagatatggtctctttygttttacttttaactgtgaaatgtaacaaatgtagagaaaagtatacaaaaaatatggttcaccgattttcacaaactaaccagtcaggttatgaagtaa

SEQ ID NO: 119013 - DNA, 201 bp, Bos taurus
tagtatctccataattacttttgaaattactagccacctgtcagcgcagggattactactatgaagaatgtcaaatgggaattaaagttttgtattaggtyaccagcattctaccatagacatattgtagatggataggactgtttcagcacacagttttattagatacaataaatttggaggcgacatactctcctgtta

SEQ ID NO: 119014 - DNA, 201 bp, Bos taurus; identical to SEQ ID NO: 77774

SEQ ID NO: 119015 - DNA, 201 bp, Bos taurus; identical to SEQ ID NO: 77776

SEQ ID NO: 119016 - DNA, 201 bp, Bos taurus; identical to SEQ ID NO: 77777

SEQ ID NO: 119017 - DNA, 201 bp, Bos taurus
atttgtctgagaagctataatacagaaaaatagaagttggtctttatgatttagatcagcaaattctttcaagctattaaaattcttccataacctgattkaattggcattgtgcaattaaattatttattcattgaattgaagcttcagtatttacagtacgcattacactctctgagatgttctttagttttgcattat

SEQ ID NO: 119018 - DNA, 201 bp, Bos taurus; identical to SEQ ID NO: 77782

SEQ ID NO: 119019 - DNA, 201 bp, Bos taurus; identical to SEQ ID NO: 77783

SEQ ID NO: 119020 - DNA, 201 bp, Bos taurus; identical to SEQ ID NO: 77784

SEQ ID NO: 119021 - DNA, 201 bp, Bos taurus; identical to SEQ ID NO: 77785

SEQ ID NO: 119022 - DNA, 201 bp, Bos taurus
gcagcacagtgatgaataaattcaaacaaagctgaaagtaagaccctaggacttaatacagtgtaagaaaggcctgggcaaagagagacagagagattgarggaagcaagtcagagaaattcatggtagcctaggtaattgacagtagttttggggagaagagcaggtgattgtatgcctaactttcatgaggtagggata

SEQ ID NO: 119023 - DNA, 201 bp, Bos taurus
ccttatctctccttctacttgcctggcttacatctctctcatagcatgtgttgaaaagcaaagaaaacacttgctcacttaaacctctggaatgtgattcraagcctatcttcttagccattaatacataactgcctcaggatttccgtttcttctcatctatgacttcacagagatagagtgtgggttttttgctttcat

SEQ ID NO: 119024 - DNA, 201 bp, Bos taurus
attatcactgacattataatgttttatttgcatccttatttatttacttagttacttataatctgtctaactgacaaaatattaaatgccctgaaagcagraaatttctctaagttatctgtcaccatatttaatcccctggaactatagtggtaaacggttcattctcagtaagtgttaatcaataaataaattatatga

SEQ ID NO: 119025 - DNA, 201 bp, Bos taurus
aactggggaaaaaatgccttaaaatatctggcccttgtcatatctaagatctaccttccagaatatcagtttttacaagagtgttcaaaggaaagaatttmaaccaaggccttcaaacattaaacactaacttgttctaaagtccataaagagattccagaacacctgtggtggacgctctaagaaagggagtgaatgcct

SEQ ID NO: 119026 - DNA, 201 bp, Bos taurus; identical to SEQ ID NO: 77787

SEQ ID NO: 119027 - DNA, 201 bp, Bos taurus; identical to SEQ ID NO: 77788

SEQ ID NO: 119028 - DNA, 201 bp, Bos taurus; identical to SEQ ID NO: 77789

SEQ ID NO: 119029 - DNA, 201 bp, Bos taurus; identical to SEQ ID NO: 77790

SEQ ID NO: 119030 - DNA, 201 bp, Bos taurus
aggtaaatagtatggttaaaggtattgactgccaacagttattgaccgtaagaatattatatccaatacatcatttaatactcattacagtcttatgaatyagctcccagtggtattctcaatgtaggttgaggaatctagggtaccgaaaatgtaaataaatgcccaagattgtatgccattaacattatattaatgtta

SEQ ID NO: 119031 - DNA, 201 bp, Bos taurus
agattatttttctattatctgaattaaggaagaatttaatagcatgcctatctatttcaatttcatgaacctcatgattgattagccatggccaaatatcrcagcttgccaaacttactgattttacctcaccctgcttttcatgacagctatcatgcttattgtgtcatttgtaattaacctatggcactcggcctctgc

SEQ ID NO: 119032 - DNA, 201 bp, Bos taurus
gtgctatctttatgatttctaacttggtatcatagcttgaaaagtcttttgaacatgaaattataaaaatattcttcagggtcttcacttttgtatatgcmaatatctactacataaattttagttatcctcaatttatataaacagaaataaaattaaatattcaacactatttcctgaatattctgtcaccttcaacca

SEQ ID NO: 119033 - DNA, 201 bp, Bos taurus; identical to SEQ ID NO: 77795

SEQ ID NO: 119034 - DNA, 201 bp, Bos taurus; identical to SEQ ID NO: 77796

SEQ ID NO: 119035 - DNA, 201 bp, Bos taurus; identical to SEQ ID NO: 77797

SEQ ID NO: 119036 - DNA, 201 bp, Bos taurus; identical to SEQ ID NO: 77798

SEQ ID NO: 119037 - DNA, 201 bp, Bos taurus
aagataaaggagttattgtacatgagaacaatttccaagtttctgaaaggaagtaaacactaaatctccctataaaggacttgtaccattctgggatttaytgaaagccagacatccatctatctgcttgcactaaggaatctttgcttcaaatcacaaagttagggaggaagtattctgagattagagatctatattcaa

SEQ ID NO: 119038 - DNA, 201 bp, Bos taurus
taaagataatggatatgaattctggctgccaattggcaatatctagcccatggagtagacctgatgacttttgtgctgtttctaacattccttccataagrgcagtcaatagcagctgtacctacagtacgcactccagcccagtatgggaaagaccaagtaacaatgaaaagaacctgtgcaacccagatggtcctacct

SEQ ID NO: 119039 - DNA, 201 bp, Bos taurus
gctgagggcagatatatggatggccataaaaaggaattagaacaaataattttaaactcttcagatatttcttttactagttctcatctctgcccttcctrtacattgtttcccctcgtccctctgaagactgactttttttttttgctttgtgcacaagcaaattacagatgaagcacagctctctagctaatatgtcgg

SEQ ID NO: 119040 - DNA, 201 bp, Bos taurus
tggcagtttgtacaaatgcaaagggtatagttgcatacaccatggttagcttaaactggcacagaaaagcatttctttttctgacaagcagaagcccacayggagcaagataaacatacagataaagaagactaaacacaatagaagtgtgccaggaaatgcattaggtagccatcccacggtcttccagggtcaaatata

SEQ ID NO: 119041 - DNA, 201 bp, Bos taurus
aaggatgtatagatactgactatgattaaactgaaggctaacagatatacatttttcaaaaatgtatgactgatcaccatttacctttggtatattacagrcaggatatgtttcaagtattgtttaaatcaagagaaatttcccagtgcacagcagtgttacagttaatacaaatcctctagggtagaggctaagcaactg

SEQ ID NO: 119042 - DNA, 201 bp, Bos taurus
cttacaaggcccgcctgcagtccaacggctgggacttgacctccctggagccccagctagcccctcaggtccttcgccgcatggaggacctggaagtgggraagatcacggcggggttcgagcaaatcacgcaccaggcagtgagaaaactcagcaaagctgagatgcagaaggtcctgaaagaggcctgaactccacgag

SEQ ID NO: 119043 - DNA, 201 bp, Bos taurus
tgagttacagcataatctaaagttatataaatatttacttagatgacaaaatacttagctgtaaaataatattacctttggagatattttaaaatttacartatgaatgattttaatctcagatggtataaaacaaatgcaataatattttctcttgagtgcttagactgtttcagaaacaaagatacgagttaatttcta

SEQ ID NO: 119044 - DNA, 201 bp, Bos taurus
tggtggtcaaaattgctatcacactcctcgtaaccctaacccagaagacaacagaacaatgcctccaaaattgtgaaaggaggtatatccaaagtctaggyttatataaccaagcatagtagtaactaacactctatatgacaggcaggctgggtggattattctctcttctctcatcaagcatgcctttcttaaggccac

SEQ ID NO: 119045 - DNA, 201 bp, Bos taurus; identical to SEQ ID NO: 77803

SEQ ID NO: 119046 - DNA, 201 bp, Bos taurus
ttttgttctcataaacggtaaaccagaatatttttcacacaaattcctcccacaatctacagatttgatccagttcaagaatgcaaaggaaaaaatgcctrttctccactaccatgagccaaatctcatcagcttcaggaataaggcagaaagaagtccatttcatctattaacttcactgaatggccctggactgtctta

SEQ ID NO: 119047 - DNA, 201 bp, Bos taurus; identical to SEQ ID NO: 77804

SEQ ID NO: 119048 - DNA, 201 bp, Bos taurus; identical to SEQ ID NO: 77805

SEQ ID NO: 119049 - DNA, 201 bp, Bos taurus; identical to SEQ ID NO: 77806

SEQ ID NO: 119050 - DNA, 201 bp, Bos taurus; identical to SEQ ID NO: 77810

SEQ ID NO: 119051 - DNA, 201 bp, Bos taurus; identical to SEQ ID NO: 77811

SEQ ID NO: 119052 - DNA, 201 bp, Bos taurus
ttaaatggtgaactatttcagacttgctgcatctcattttttcactaaaaatatatcttggatatcattttatataaacacatgaagctagatctgttttwcccccagtggctgcatagctgtttgtagatgtaccagaattatttatccactttcctgttgatggatattttggtagttttcattcttccctactgccat

SEQ ID NO: 119053 - DNA, 201 bp, Bos taurus
aacacaaaaattaagtgaagtggggaattgggccaccatgacaacttcagaaaaaaggagccatcttctaagtacttttacacaaaagaggaaaatgaatkaatgagaattaatgaattaaagagaatttagagttttggacaaagttctaactaaaatagtatatcatacaacgtaacctcctcatttaataaatatgtt

SEQ ID NO: 119054 - DNA, 201 bp, Bos taurus; identical to SEQ ID NO: 77814

SEQ ID NO: 119055 - DNA, 201 bp, Bos taurus; identical to SEQ ID NO: 77817

SEQ ID NO: 119056 - DNA, 201 bp, Bos taurus; identical to SEQ ID NO: 77818

SEQ ID NO: 119057 - DNA, 201 bp, Bos taurus; identical to SEQ ID NO: 77819

SEQ ID NO: 119058 - DNA, 201 bp, Bos taurus; identical to SEQ ID NO: 77820

SEQ ID NO: 119059 - DNA, 201 bp, Bos taurus
ctagttctgagaatctacttgtgaaataacaatgaataatatcagagcccagatttaaaatccctgaaattgcagtggtttctctgtggccaacaacaaaraaatatgccccttctgtgagcttgctagcacgtcaatgcacagcaggcttgtaaataattttctaagcactcactctgcagtgagtgttgagaaaggcca

SEQ ID NO: 119060 - DNA, 201 bp, Bos taurus; identical to SEQ ID NO: 77822

SEQ ID NO: 119061 - DNA, 201 bp, Bos taurus
agtttccttgagatactcaaaagctctactctctcccttatcctaaacaatgtcaaacattatagtttttgttatagcagcatttaaatcttgggtgttcrcttctgtctggattagtttttgcagcataccaagttagcctaagatttagtagcctaaaatgacatcgttctgtgagttgactactgttgattgagtggt

SEQ ID NO: 119062 - DNA, 201 bp, Bos taurus
gaaaaattcacagaaataatatttgagctcctggctgagagaagctggatggtggtgctgtgctgcaatgggaatggccaacagatggcagcagcctgaaygcagcatcgggagtcaggagtgtagctggcaactcgctaaggttgaagattaatggtctcacaatgtacaaaggtacacagaggacactggggccccgaa

SEQ ID NO: 119063 - DNA, 201 bp, Bos taurus
acatccttgccaacactaatgtctgtcttttctatttcagccttccaaggtgtgtttgaaggtgttgctctgtatttccctaatgacaatttttcatgtgmttactggccatttacacgtctttgggtaaatatctattcaattctttgttcactttttaattgggctatttgtcttcatcactgcatgttaaggactctt

SEQ ID NO: 119064 - DNA, 201 bp, Bos taurus
agggctggaaggggcccaataaggcactgtggggcctgaagcaagaaggcaaatccaccttcagggtggatccttcaggggtgggtgctgatggtgggcayccatcagtcaggggccaggcaagcgccctagaaataagagctgcacataccacatcagaaaccagatgaggcaggactactgtgaggctggtgaagagat

SEQ ID NO: 119065 - DNA, 201 bp, Bos taurus; identical to SEQ ID NO: 77829

SEQ ID NO: 119066 - DNA, 201 bp, Bos taurus; identical to SEQ ID NO: 77830

SEQ ID NO: 119067 - DNA, 201 bp, Bos taurus
atctaggttggtcataacttttcttagttttaaaaacaaacagatgttggtgaggggagggataaaccaggagcttgggatgaacacacatgactatacayaaaatagttagccaacaaagacctatggtacagcacagaaaaatacactgaatattctgtagtaatctttatgtgaaatgaatctgaaaaagaatggata

SEQ ID NO: 119068 - DNA, 201 bp, Bos taurus; identical to SEQ ID NO: 77832

SEQ ID NO: 119069 - DNA, 201 bp, Bos taurus
aacactacatcaaaccctccttgatctatatgattttacctcacttatcactcagtctatgtccctacaagattctggccattctctttccagacttttcmcattgcaggcttgtaccttcttccttttgtcctctatcattttgctcctaaaatctgaaaggagcattctcttctgtctgaagtttcagcttaagttctc

SEQ ID NO: 119070 - DNA, 201 bp, Bos taurus
ctggcagctctgaagctggtgtcagcacactggtcattggtaccaaggaccagtgtgtcctgaagctagcgcctgtccagcgatgagtgaagttaatcctsaagtctctgcctgcagggccctggatgttccagagcttgtgtcacccaacaggaagacaggatcagggcctgcggattccagggctcatgcctctctcct

SEQ ID NO: 119071 - DNA, 201 bp, Bos taurus
ttttattggctgaggcttgctacgtggaccaatgtaattgtcaagacttccccctttcttcacaaaagtatcccagtttatatgataaatagtatggccaycctaagaataattcattattaaagcaggagaggatatagtttctcctgctttctttcacgtgggcttagcccagtatagtcaatcttccccaggccaatt

SEQ ID NO: 119072 - DNA, 201 bp, Bos taurus; identical to SEQ ID NO: 77834

SEQ ID NO: 119073 - DNA, 201 bp, Bos taurus
aggatacagaggaaacataaaggtgtggggcataaaatattgggtcactgaggaactggaaaaatcatcagggaaatcaaatctccatctcaagcggattytgctcatccctgttttcctctctgcagactggtttatttactctttcaagaatatgaattaattactcactcaattcaagcagatatgttattcaagcac

SEQ ID NO: 119074 - DNA, 201 bp, Bos taurus
taaatttcatcactgtgctcaccgtatgcccagcacgctaaggcagagtgctaagtggaaccctttctctgtggaccaggggaggtcagaatgtaaataargcagaagaagatgccttgggaagtgagggaccatggggattagagctgggcataaatcatagctccacagtaaagcaacacagggttttactttggcact

SEQ ID NO: 119075 - DNA, 201 bp, Bos taurus
accttaagagatacatacatatgctctatattttcttgagctggctgtggtattttgcattcttccatacaatctatattcattttaaaattgcaattcaytgtagtaagtttattcagaataatccatgatctttaagaattctctacacttatatgccactgtgcataccctatttgtgaccatcttttttaccttaat

SEQ ID NO: 119076 - DNA, 201 bp, Bos taurus
ctttgtaatattcctcattggtttatcctttgtgattcttatggaagtggaggtaaagaatattgactatgaaggggtttgctgagcaattattcataacrtgcaaaaaaaaagcaatcaagtttatcagattcggtcacttaattttatatcattctgcatattgtctttatttgatttttgactagctacatgcacatt

SEQ ID NO: 119077 - DNA, 201 bp, Bos taurus
aagcccagaggtatcatttccagaagggagttcagtgagggtaacaaccattttgtcaacttcgctccagtatccgatctgaaaaaagacacagaaagagygcacttggatacacggcctttctattaccaaagcactgagttattttcaaacccatgtctgaatctgaaattacacctatcctaactagacttgtcctaa

SEQ ID NO: 119078 - DNA, 201 bp, Bos taurus
tctgttacaaaaaattaatgcttagataatagcacactcatcatcgcgatttcctttgtacttgtctcattcactgtaggcctaacattttatttcatttraatatttatttatttatttggctgtacagggtcttagttgtggcatgtgaactcttagtgcagcaggtggaatatatttccctgaccaggaatggaacct

SEQ ID NO: 119079 - DNA, 201 bp, Bos taurus; identical to SEQ ID NO: 37990

SEQ ID NO: 119080 - DNA, 201 bp, Bos taurus; identical to SEQ ID NO: 77843

SEQ ID NO: 119081 - DNA, 201 bp, Bos taurus
tctcatacatacatattgtatacatgttcttttccattgtaggttattagaagatattgaatatagttccctgtgcttgtttaactgttttataaatagtygggtatacctgtttatcccagtctcctaattatcttctcccctcccacactctcccctggtaaccataagtttgttttctctctgtgaatctatttctgg

SEQ ID NO: 119082 - DNA, 201 bp, Bos taurus
gggacccagctgagctttagtcctgaggggatggatcttctgtatcctcacagcaccttcaaagcagatccaaatgagatgcccctccaatggcctggccrgagttggggggacccctggcatctgcccatcatctctcaataagttatgcatcatggtcaccaatgatggagactggaggggcctccaagaagttcagtg

SEQ ID NO: 119083 - DNA, 201 bp, Bos taurus; identical to SEQ ID NO: 37993

SEQ ID NO: 119084 - DNA, 201 bp, Bos taurus; identical to SEQ ID NO: 37994

SEQ ID NO: 119085 - DNA, 201 bp, Bos taurus; identical to SEQ ID NO: 37996

SEQ ID NO: 119086 - DNA, 201 bp, Bos taurus; identical to SEQ ID NO: 77851

SEQ ID NO: 119087 - DNA, 201 bp, Bos taurus; identical to SEQ ID NO: 77854

SEQ ID NO: 119088 - DNA, 201 bp, Bos taurus; identical to SEQ ID NO: 37999

SEQ ID NO: 119089 - DNA, 201 bp, Bos taurus; identical to SEQ ID NO: 38000

SEQ ID NO: 119090 - DNA, 201 bp, Bos taurus
atctgcaaccatggtgagccgcatgcaagtcccctaatagcaagggaaggagaatgctttcttagagagaaaaaggaaggtgaaagggctttagtaaacamtccatggattgttcactgactgagtccttgccagaaaagaagaggattcattctccttttggtctcagctatcattgcaaagcatcagagctccccctct

SEQ ID NO: 119091 - DNA, 201 bp, Bos taurus; identical to SEQ ID NO: 38001

SEQ ID NO: 119092 - DNA, 201 bp, Bos taurus; identical to SEQ ID NO: 38003

SEQ ID NO: 119093 - DNA, 201 bp, Bos taurus; identical to SEQ ID NO: 77860

SEQ ID NO: 119094 - DNA, 201 bp, Bos taurus; identical to SEQ ID NO: 77861

SEQ ID NO: 119095 - DNA, 201 bp, Bos taurus; identical to SEQ ID NO: 38005

SEQ ID NO: 119096 - DNA, 201 bp, Bos taurus; identical to SEQ ID NO: 38007

SEQ ID NO: 119097 - DNA, 201 bp, Bos taurus; identical to SEQ ID NO: 38008

SEQ ID NO: 119098 - DNA, 201 bp, Bos taurus; identical to SEQ ID NO: 77866

SEQ ID NO: 119099 - DNA, 201 bp, Bos taurus
ccttctgctaacagcaccctggatctcctgtgagggccccttctctccctcttccggcttggtgtttcaggtgacatcatccctgaacccacagttgagcrtgtgatccagcctggccaatcagagcttcagcttcctctgaacaattggtttagggaaagccatgtgacccagtctgaaccaatcagagctctccatcag

SEQ ID NO: 119100 - DNA, 201 bp, Bos taurus; identical to SEQ ID NO: 77870

SEQ ID NO: 119101 - DNA, 201 bp, Bos taurus; identical to SEQ ID NO: 77871

SEQ ID NO: 119102 - DNA, 201 bp, Bos taurus; identical to SEQ ID NO: 77874

SEQ ID NO: 119103 - DNA, 201 bp, Bos taurus
ttggtttgtgtcaagggtcacacagaactgtgtcacatcccacatgtgctgggtatccctggggctgggcacggctctccctgacactgactgtcaggagraaatgggcccttgggtgtgggtgggatgggtctggttctcagctttccctgggctcagctctccccacacatgcttgttctgggtctgtgtccccatgag

SEQ ID NO: 119104 - DNA, 201 bp, Bos taurus
acctggagaactctcgtgccaccacctgggaccctgggcagctgtggctggagctacgccaccacctcatcaccttgggtatttttcaaactcattaacargctttggacaagtaaattgtgtgttcttttgtaatgatgacaaccatgagctctttaaaccctgttatcagagtggaatcaagataatatcccatgtgaa

SEQ ID NO: 119105 - DNA, 201 bp, Bos taurus
cctggaccaacacttctgggagactgaccccagctgtggaactggcacgtgctgtgtgcatgtgtgtgtgtgtgtgagagagagagcatagcacaggtcarcaaggccttcccagagggttactgaggtcctttgaggatcgggttgatgggggaggggtcaaagccatgttagtaaggtatccacttactttataagaag

SEQ ID NO: 119106 - DNA, 201 bp, Bos taurus; identical to SEQ ID NO: 38016

SEQ ID NO: 119107 - DNA, 201 bp, Bos taurus; identical to SEQ ID NO: 38017

SEQ ID NO: 119108 - DNA, 201 bp, Bos taurus; identical to SEQ ID NO: 38018

SEQ ID NO: 119109 - DNA, 201 bp, Bos taurus; identical to SEQ ID NO: 38020

SEQ ID NO: 119110 - DNA, 201 bp, Bos taurus; identical to SEQ ID NO: 38021

SEQ ID NO: 119111 - DNA, 201 bp, Bos taurus; identical to SEQ ID NO: 38022

SEQ ID NO: 119112 - DNA, 201 bp, Bos taurus; identical to SEQ ID NO: 38023

SEQ ID NO: 119113 - DNA, 201 bp, Bos taurus
accatggatggtgtccttttaagagacaaagagaacaccacatgaagacagacgcagagatgggaacaggagctggaagcatcgaggaaggagcttctccyggagcctctggaggcaggatggccctgctagtatgtctggcctccagggctgtaggagaatacgtttctggtttgtttttttttttagccaccaaatcac

SEQ ID NO: 119114 - DNA, 201 bp, Bos taurus; identical to SEQ ID NO: 77883

SEQ ID NO: 119115 - DNA, 201 bp, Bos taurus; identical to SEQ ID NO: 77884

SEQ ID NO: 119116 - DNA, 201 bp, Bos taurus; identical to SEQ ID NO: 38025

SEQ ID NO: 119117 - DNA, 201 bp, Bos taurus
ttttctgcagtcctattagattggaatccccaggataaaaaggacttttcctctcttgttcagagcagcatctttcatgcctggaatggggcctgccacaygcactcgggaaactgggtcttcaatgatgtcacatcagccccttgggcagaatcggatgtgatattcctgtatcatgatctcagagcatcttcatcccca

SEQ ID NO: 119118 - DNA, 201 bp, Bos taurus
tgtaaatctccaagaaattaacattcagtagaactcatggggatttggaccatgcttttgtcttttctgcaggacaaaatgtctcaaaagtcaaggtgatyagtgggttcctagaaaacagatgacatggcaacactttgctttcctggctctatttatggatagaaggtacacatcaggtcatcattccactttttcctc

SEQ ID NO: 119119 - DNA, 201 bp, Bos taurus
gaaggatcgtagacacacagcaggcctgtacttctctttagagagtgttgagtgtggcttagcatagtgatagtcatcgtgatgattggggtttgctttcrgcacctgtaggtggggcccagaatgacagatggttccacacaatgaagaatgtcccttacgcagtttgaaattctaatgttctgcagacatttttgtagg

SEQ ID NO: 119120 - DNA, 201 bp, Bos taurus; identical to SEQ ID NO: 38037

SEQ ID NO: 119121 - DNA, 201 bp, Bos taurus; identical to SEQ ID NO: 38038

SEQ ID NO: 119122 - DNA, 201 bp, Bos taurus; identical to SEQ ID NO: 38039

SEQ ID NO: 119123 - DNA, 201 bp, Bos taurus; identical to SEQ ID NO: 38040

SEQ ID NO: 119124 - DNA, 201 bp, Bos taurus; identical to SEQ ID NO: 77897

SEQ ID NO: 119125 - DNA, 201 bp, Bos taurus; identical to SEQ ID NO: 38041

SEQ ID NO: 119126 - DNA, 201 bp, Bos taurus; identical to SEQ ID NO: 38042

SEQ ID NO: 119127 - DNA, 201 bp, Bos taurus; identical to SEQ ID NO: 38044

SEQ ID NO: 119128 - DNA, 201 bp, Bos taurus; identical to SEQ ID NO: 38045

SEQ ID NO: 119129 - DNA, 201 bp, Bos taurus; identical to SEQ ID NO: 38046

SEQ ID NO: 119130 - DNA, 201 bp, Bos taurus; identical to SEQ ID NO: 38047

SEQ ID NO: 119131 - DNA, 201 bp, Bos taurus
gctgatttcatgcctctggagaagcataaaccgtgttctttgtctgaatgtcagtttcacctcagcatagtttctggttctgtctgtcagcttcacagatytcatgtttcaactctccattcacttgtcacctctcttgagtggaggagggtacagagccgactcctattagagacggcagagcagactaaaaggagtgat

SEQ ID NO: 119132 - DNA, 201 bp, Bos taurus; identical to SEQ ID NO: 38050

SEQ ID NO: 119133 - DNA, 201 bp, Bos taurus; identical to SEQ ID NO: 38084

SEQ ID NO: 119134 - DNA, 201 bp, Bos taurus
accaactaagcaatgagggaagaaccatccaggtaggacctgctaactggtctctttttcgtttgtcatttttctgcccccactggccaactttgactttygggtttgaacaggtgggggtagagaaagagcaatgtgtggaagttcttgcttgactgactcaattaatggttctagcttctctagactgaccggccccca

SEQ ID NO: 119135 - DNA, 201 bp, Bos taurus; identical to SEQ ID NO: 38086

SEQ ID NO: 119136 - DNA, 201 bp, Bos taurus; identical to SEQ ID NO: 38087

SEQ ID NO: 119137 - DNA, 201 bp, Bos taurus; identical to SEQ ID NO: 38088

SEQ ID NO: 119138 - DNA, 201 bp, Bos taurus
atgcacacaggagcctggcaggctacaggccaagggatcgcaagagttgaacatgactcagctactaaaccaccaccaccaattattaattaattaatgayaaagcctgtttgagaccccaagaactatagcccaccagggtcctctgtccatggaattctttaggcaagaataatggagtgggttgtcatttccttctcc

SEQ ID NO: 119139 - DNA, 201 bp, Bos taurus; identical to SEQ ID NO: 38089

SEQ ID NO: 119140 - DNA, 201 bp, Bos taurus
agcaaggagggagctagtaaactgtagaactaggattcaaatgcaggcagtatagttctagggccagtgcccctaaccatgtactatcacactcttcatcygtccatcatttactctcccctcaggaaaaaaaaaaaaacaacacttggcattcctatctctgagccttcttataggctctcggcctgaatcagtcaagtc

SEQ ID NO: 119141 - DNA, 201 bp, Bos taurus; identical to SEQ ID NO: 38091

SEQ ID NO: 119142 - DNA, 201 bp, Bos taurus
cctagctccctgaccggggatcaaacccacattctctgcattgggaggtgaatccagagaattcttaatctctggaccaccaggaaagtccctaaagaccyttttaaaatcaccactctgctcactgaaattctctctcactacttctggggactcatcatgcatttccaaggagtctgtttcatcaccctgctcaatccc

SEQ ID NO: 119143 - DNA, 201 bp, Bos taurus
tccctggtggtccagtggttagcgctctcactgccaggggcctgggttcgatccctagctggggaactaagattccacaagctgtgtgatgtggttaaaakaaaaaagtggaggcccactgagaaattatatttgagcaaagacctgaagtgggtaatggactgagccatgtggctgtctcgtggcagagcattctaagtg

SEQ ID NO: 119144 - DNA, 201 bp, Bos taurus; identical to SEQ ID NO: 38092

SEQ ID NO: 119145 - DNA, 201 bp, Bos taurus
aacaacatgaacttacctattacatttctggagatcagaagtcctaaatgagtcaccttgagttaaagtcaggtgctgacagatctgcttccttttcgagmttctaggggaggatgcattcctgggcctttttcactgtttctagtgggtgcctgtattccttggcttgtggcttcttcctcaaaacttgaaagtacatca

SEQ ID NO: 119146 - DNA, 201 bp, Bos taurus
cacttaaaaatgtgactgtatttgaagacagggtctttaaagaggtaattaagtaaaatgaggatgggccctcgtcgttaggacgggccctaatccaactsactggtttccttcgaataggaggaaatagggacacagacacacagagaaaactatgttagatacagggagaagtcaagtacaagccagtgagagaggcct

SEQ ID NO: 119147 - DNA, 201 bp, Bos taurus
cctgaatgatgaagcatcagccttgggaaaggcatgttccagtgactgggaaaaatggttcaagtgcctgggacttaccggagtggaagaggggtacagaytgagatagaaggtggagtggggattagagcaatcaggaaactgtagcctggggaaggaatgagatttctaaatttagtgggaagttactggaggatttca

SEQ ID NO: 119148 - DNA, 201 bp, Bos taurus
aggatggtctttcctgctgtcacatcctaagagaaggctctctccaaaatgacaggctagacagggaaattttagtaagcattaggcagactactcactgytctaacccatgtttaggtcttactcattcaagcccagatactttacaagaagtttctgaaatcgactggctttctggggagtgaacagtgggcagtgatt

SEQ ID NO: 119149 - DNA, 201 bp, Bos taurus
agtcaggacaacatgcctacttgctctttcatgttctctgtaactttctggatcattgtgaacagcttcagagtctaaagaaaggattatttagaaaagaycctcaatgctgagagaagataatcaatgttactctagtgacaggaaatacagtctatagaactgcagagaaccacttagaggatattgatgttttggtta

SEQ ID NO: 119150 - DNA, 201 bp, Bos taurus
aatggccaatcaggtaaatgcttagactggtgcgaaggaggtgcacagagaataggagctgtgactcctgcaagtgcccgtgcagtgaatgagcccctgtrctcattttccggcccctccccaggccggaagaagaaggggaagctcaaagaagggcagcagctacacttgttgtaaaaacaaaacgaactctttcataac

SEQ ID NO: 119151 - DNA, 201 bp, Bos taurus; identical to SEQ ID NO: 38095

SEQ ID NO: 119152 - DNA, 201 bp, Bos taurus
aaattaactacacgatgaccagactgtacccaggacatacaccgccacaattccaagaactggcctcaaagaagtgtgaacaagtggaccccagaaccgawgatgaactgtacttaaccaagatgacactggtcagaccactgatgaccaatctgaagatgactgtcagagctgactgtgctgtttctgcatgtagcctcc

SEQ ID NO: 119153 - DNA, 201 bp, Bos taurus
tgaagcgagccaggtgccagggagggacagcaaggagcccacggcatgtcagtggggacagcagctgcccagctccactcaggctgccgtgtaaataaaaygggcctggagttgctgaagcttttgacttgtcagaagacatcagatgtttctgtgccatctctccatctgtaatcgtcggtgactcgtctaaacgtgttc

SEQ ID NO: 119154 - DNA, 201 bp, Bos taurus; identical to SEQ ID NO: 38102

SEQ ID NO: 119155 - DNA, 201 bp, Bos taurus; identical to SEQ ID NO: 38103

SEQ ID NO: 119156 - DNA, 201 bp, Bos taurus; identical to SEQ ID NO: 38104

SEQ ID NO: 119157 - DNA, 201 bp, Bos taurus; identical to SEQ ID NO: 77999

SEQ ID NO: 119158 - DNA, 201 bp, Bos taurus
cggtggtgggaggagcctggcttcgagggcaacttacgtttttgtgaggaatgacgtgtgggatgtactgcaggatcagctgggcccgctttctgtccttrtcaagttcctggaagagcacgctgggtttgagatccctgaagagcaaagacacgggtttgggataaagagcatgaataccatcctccagacaaggttggc

SEQ ID NO: 119159 - DNA, 201 bp, Bos taurus
ctttcttacagtctgcaccgcccacttcctcctcttggcctccttccgagccagggctccacgccagtgggcttcgagtgtaatggctgaaagaggtcacygctggcattagaaggtgagagcaatcccttaaatacaagagcctcttcaagaatgacgcaccccctccacaaatgcctggacgccgctgcagcactccgc

SEQ ID NO: 119160 - DNA, 201 bp, Bos taurus; identical to SEQ ID NO: 38105

SEQ ID NO: 119161 - DNA, 201 bp, Bos taurus; identical to SEQ ID NO: 78004

SEQ ID NO: 119162 - DNA, 201 bp, Bos taurus; identical to SEQ ID NO: 38108

SEQ ID NO: 119163 - DNA, 201 bp, Bos taurus; identical to SEQ ID NO: 38111

SEQ ID NO: 119164 - DNA, 201 bp, Bos taurus; identical to SEQ ID NO: 38112

SEQ ID NO: 119165 - DNA, 201 bp, Bos taurus
gttttcctttttactggtaagtcattcctggggatcttgggagacataatatagacttgagatgcagctccttaagggcctgaaaaggtgggacttagcayccccccagcccacccttcctggtctcctgggggtggttgacctcctggtgtgctcacctctgccgtcacaagtcagtggacttcgtgtagcggccacatc

SEQ ID NO: 119166 - DNA, 201 bp, Bos taurus
catgggatttgccaggcaagagtactggagtgggttgccatagtcacctggaaatagcagctaagttctccctggagataaatgctgggggcaagtctatycacctcctcccttcatctgtttcttccacatgtattgtgaaaccaaaagcctcaactgaaaaccacagacagtgataataataaccgcactgcagtcttt

SEQ ID NO: 119167 - DNA, 201 bp, Bos taurus
gttcttccacaggagtgcggggtctgaaccctatgttgagctctagggggcctgaaccgggaagatgagcccccagagcagttgattttgaaggccagggraccttcaggggtcccaggaagctgtagaaaatagaggcttcatcctttaaggatgcacacaaaatcttatgtgaaccgggacacagggcagaagtaactt

SEQ ID NO: 119168 - DNA, 201 bp, Bos taurus; identical to SEQ ID NO: 38113

SEQ ID NO: 119169 - DNA, 201 bp, Bos taurus; identical to SEQ ID NO: 38114

SEQ ID NO: 119170 - DNA, 201 bp, Bos taurus; identical to SEQ ID NO: 38116

SEQ ID NO: 119171 - DNA, 201 bp, Bos taurus; identical to SEQ ID NO: 38117

SEQ ID NO: 119172 - DNA, 201 bp, Bos taurus; identical to SEQ ID NO: 38118

SEQ ID NO: 119173 - DNA, 201 bp, Bos taurus
gatctctcacccttggattcacagcaggggtgggctgagggagctggggttgctgaagcccagagaaggcagggccttggcctgcgtcacccagcaagcckagggcagagggctgttgaccccaggctccaggcagggacatgttatttattgctagattggcctctgtcctcagtgagtttaatttctccactttctcac

SEQ ID NO: 119174 - DNA, 201 bp, Bos taurus; identical to SEQ ID NO: 78013

SEQ ID NO: 119175 - DNA, 201 bp, Bos taurus; identical to SEQ ID NO: 78014

SEQ ID NO: 119176 - DNA, 201 bp, Bos taurus
cccgttccactggccagaatcaaacagtctcacagacagagagaaaactctacaccacccaaaaggggagaggaaaaggagtgagcacgtattgacccatrtttccgtttactacctgcaggccatagacccttttggagggctgtgggtggagcagtttaagaactggattggaacctgagtctcgtatggtgatttgca

SEQ ID NO: 119177 - DNA, 201 bp, Bos taurus; identical to SEQ ID NO: 78057

SEQ ID NO: 119178 - DNA, 201 bp, Bos taurus; identical to SEQ ID NO: 78058

SEQ ID NO: 119179 - DNA, 201 bp, Bos taurus; identical to SEQ ID NO: 38161

SEQ ID NO: 119180 - DNA, 201 bp, Bos taurus; identical to SEQ ID NO: 78060

SEQ ID NO: 119181 - DNA, 201 bp, Bos taurus
attttaaaaattaaatttaaatttgattaatccttttggttccacctgtgaaatctgaatcattttgtaatataatcctgtggaagtcatgatgtttttaytgactgatttgaggctagcttagcaaataggtgggatctgaggttctgtggagcagctgagagtagttcctggggtgtaaaaatggttcaacaggtaaag

SEQ ID NO: 119182 - DNA, 201 bp, Bos taurus; identical to SEQ ID NO: 38164

SEQ ID NO: 119183 - DNA, 201 bp, Bos taurus; identical to SEQ ID NO: 38165

SEQ ID NO: 119184 - DNA, 201 bp, Bos taurus; identical to SEQ ID NO: 38166

SEQ ID NO: 119185 - DNA, 201 bp, Bos taurus; identical to SEQ ID NO: 78063

SEQ ID NO: 119186 - DNA, 201 bp, Bos taurus; identical to SEQ ID NO: 78064

SEQ ID NO: 119187 - DNA, 201 bp, Bos taurus
tggaggcccagctttcgtgctgagcgcccctctggctctattcaaatcccaggcgtgtggataccatcgcagagtctggctctttctaggactgagaacamgtggtcccaggccctcgcctcccaggccccagtgcagtccccagggcacctggtgggtaggtagaggtggggggggcgggctggggaggctggctcttcc

SEQ ID NO: 119188 - DNA, 201 bp, Bos taurus
acgtgcctacagggtttttgagggcctgtgcatgtggtcccaacctgtcccatcttctgggtccctgggaaacacacgattcctttacacacccctggacrggcccctctggccacactgtcctgagggtgaagctcgctaatcctggagaccccactctgcatggcgtgggctggagggaagaacttcagcctctttctg

SEQ ID NO: 119189 - DNA, 201 bp, Bos taurus; identical to SEQ ID NO: 38172

SEQ ID NO: 119190 - DNA, 201 bp, Bos taurus; identical to SEQ ID NO: 38173

SEQ ID NO: 119191 - DNA, 201 bp, Bos taurus
gccgcctgcaggaggtcctgtcgcagctgcgctgggagacgcacggcgagcaggcctcgcgcatccgccacctggaggccgcgctcgacgtggagcgccgrctgtttctcaagtacatcctcgagcactttcactggcaccccgccctgcccagcgcccccgacgcccctcttccattgggagaaccgactcgcgaggccg

SEQ ID NO: 119192 - DNA, 201 bp, Bos taurus; identical to SEQ ID NO: 38175

SEQ ID NO: 119193 - DNA, 201 bp, Bos taurus; identical to SEQ ID NO: 38176

SEQ ID NO: 119194 - DNA, 201 bp, Bos taurus; identical to SEQ ID NO: 38177

SEQ ID NO: 119195 - DNA, 201 bp, Bos taurus
ctggggcgctaacaaccccaaggggcttgtgactccatccctgagtctgccgcgcgctcctgccttgacagacagctgtcgagactgccttctggcctctrgtgtcctgtggcgcacgggctggctggggtgtggtgcccgtggaacctgcatggagccctgggctccctggccgccaccccctcgccccctctgctctgg

SEQ ID NO: 119196 - DNA, 201 bp, Bos taurus
ctgcccgggctccccacgggggcgcccaggagcagagtggccgctgcggagtgacccgaagctggagatctaactctcgagccctcgggacgcagcctgcrgactcctgagctgagggccaccccaggagcccagggagacggcagcgagggcagatccggtcctccacccacgggagaagcaaagcgcctcggcccgggg

SEQ ID NO: 119197 - DNA, 201 bp, Bos taurus; identical to SEQ ID NO: 38181

SEQ ID NO: 119198 - DNA, 201 bp, Bos taurus
ccccctcagcacccaggcctcctggatgtgaactggggcagatgccacaccctccccactggtgggtctggagctcctccagcagcctggatcccatccaytgtcctcctgccccggcctttggcagacggggaaaatgcattaattcagagtgcttagaagagggctggaagcactgagatcttggtgggtgtcacaggt

SEQ ID NO: 119199 - DNA, 201 bp, Bos taurus; identical to SEQ ID NO: 78085

SEQ ID NO: 119200 - DNA, 201 bp, Bos taurus; identical to SEQ ID NO: 38182

SEQ ID NO: 119201 - DNA, 201 bp, Bos taurus; identical to SEQ ID NO: 78090

SEQ ID NO: 119202 - DNA, 201 bp, Bos taurus; identical to SEQ ID NO: 38186

SEQ ID NO: 119203 - DNA, 201 bp, Bos taurus; identical to SEQ ID NO: 78092

SEQ ID NO: 119204 - DNA, 201 bp, Bos taurus; identical to SEQ ID NO: 38188

SEQ ID NO: 119205 - DNA, 201 bp, Bos taurus; identical to SEQ ID NO: 78094

SEQ ID NO: 119206 - DNA, 201 bp, Bos taurus
gaaaatgtgcatcagatactgttgtctaagtacttcagagaggaggcaaagccgaggacttatggggaggattctctcacctgaaggcctcataggtcctrcttagttacaatagcatcacaatgcttgtgtactagaaacacttattttacttaataatggccccaaagtgcaagagtagtgatgctgcaattcagatat

SEQ ID NO: 119207 - DNA, 201 bp, Bos taurus; identical to SEQ ID NO: 78101

SEQ ID NO: 119208 - DNA, 201 bp, Bos taurus
catgaaccaacttgggcctggcctgggagattttgcagacgtcacaggtaatcagagacttacaggctcagtaagagagtcagcagaagggataggaaaayttcttagccaactggggttacaggggaaaaatagcctggggctaggatgagcaaagaggaaaacaggtaggcagtccagtctcctataataggagttagg

SEQ ID NO: 119209 - DNA, 201 bp, Bos taurus; identical to SEQ ID NO: 38197

SEQ ID NO: 119210 - DNA, 201 bp, Bos taurus
cttgggaggtgctattgacaggccaacagagagttattgattttgcgaaaagccagatacttttgagtaaacatggaacgtgagaggcccccagagaactwgtgccctgagaggctctgggagctgtcacagcaggtgccactttggagtcactgcggagattggtcccgagggtgcagccaccatagctgcactcaggtg

SEQ ID NO: 119211 - DNA, 201 bp, Bos taurus; identical to SEQ ID NO: 38199

SEQ ID NO: 119212 - DNA, 201 bp, Bos taurus; identical to SEQ ID NO: 78106

SEQ ID NO: 119213 - DNA, 201 bp, Bos taurus
ccaaacttcacgtgggaccatgcggccagcccttcccccacatcaccagaggctttggtgcagtgtctgttagtaacagtcctcctccttcacacatcacrtcagcatcctctggaagatgagggaggagcgtaggctaaatgtctgggatgagatgctcagaactaacatccaagttgtgttttaaatggcaatttcaga

SEQ ID NO: 119214 - DNA, 201 bp, Bos taurus; identical to SEQ ID NO: 38202

SEQ ID NO: 119215 - DNA, 201 bp, Bos taurus
actctcaacagagtttggaacaggacctagcagtaccaggaagtggaaacatctcaggaagcaatagagattgcaacaaacttgagttcccagggcacatytacagggctgtaagtccaagtattcaaggcttgagcttttttgccagaccagttctagctatgattttgatctttgtctcaggctatgcacatttgagac

SEQ ID NO: 119216 - DNA, 201 bp, Bos taurus; identical to SEQ ID NO: 38203

SEQ ID NO: 119217 - DNA, 201 bp, Bos taurus; identical to SEQ ID NO: 38204

SEQ ID NO: 119218 - DNA, 201 bp, Bos taurus
gtgccgcatggcggcctgggtgtagatcttgctggggaaacaggtgttgaaatccttaactatcctgctgcctggtgctaggccggatgcccaggcctccrtggggtcacattcttctttcctcacacccacctttagcagggcactgctaccatgcatgcgtgagaggttagggttctgaggactcataggactggtcca

SEQ ID NO: 119219 - DNA, 201 bp, Bos taurus
actgcgcttctagtgactaaacaaggggatggagcgcttttccattctgcagctctcacctgaaggaacattgctggcccttaaaggagcaatgtctgctygcaggtttgacttctataaccaaattgggtcagtggcgtgttctcaccctcagggcccccaggaatgacaccagcctgtacccagcttctcatccacaga

SEQ ID NO: 119220 - DNA, 201 bp, Bos taurus; identical to SEQ ID NO: 38205

SEQ ID NO: 119221 - DNA, 201 bp, Bos taurus; identical to SEQ ID NO: 38206

SEQ ID NO: 119222 - DNA, 201 bp, Bos taurus
caggtgtgcagaatcaaagctgagataattcattctcagttgccctagaatgagaagggctgtaactgtgactctctgctactttcctacatgcagtgatrtttaagccaagtgccaaacaggtcctaccctgatattaaaacatggtacaccagaccccacccctcgcagagatcttagccctcctggggagggactggt

SEQ ID NO: 119223 - DNA, 201 bp, Bos taurus
ccgtctggcagcttgattaatttatttctccttcttggagactgctgcaaggggctttggtcaccctgtgtccccatgggcctgtaacctgagtgactgcygacacattagccttacggcaaggaagccagtccattgccctgcactaggaggctttggagtcagaaggtggtttgatatgggggcctcaactcaaaccct

SEQ ID NO: 119224 - DNA, 201 bp, Bos taurus; identical to SEQ ID NO: 38207

SEQ ID NO: 119225 - DNA, 201 bp, Bos taurus; identical to SEQ ID NO: 38208

SEQ ID NO: 119226 - DNA, 201 bp, Bos taurus
gcaggtttatactgcacaccccaggcggcctcggcactttacagaccacagcataaaccctcagaaccgtcccgcccccgacggggggaaagcggtgtcaytattaatatagaagttgacaaacatcgttagcaccgtctagtccagccaccgcccctaggaggacctggtcacagtcccagggcatcttgggggcttgag

SEQ ID NO: 119227 - DNA, 201 bp, Bos taurus; identical to SEQ ID NO: 38209

SEQ ID NO: 119228 - DNA, 201 bp, Bos taurus; identical to SEQ ID NO: 38211

SEQ ID NO: 119229 - DNA, 201 bp, Bos taurus
tgctgaggttaccgccctcctcactgtggcctcaaggaacccaagaaacacactcattgcctctttggttgttttataaacagtgcttggaaaccacgagycattatcactcttctggccagccagtcagactttccatgcccttgtgtgtgatgcccttaatcctctcaaagccagcatcctcattcccctaaaccagga

SEQ ID NO: 119230 - DNA, 201 bp, Bos taurus; identical to SEQ ID NO: 78120

SEQ ID NO: 119231 - DNA, 201 bp, Bos taurus; identical to SEQ ID NO: 78121

SEQ ID NO: 119232 - DNA, 201 bp, Bos taurus
tctacaaacaggaaacgctggagaaggtgctgggaaaagggaactctcttgcactgttggcaggaatgtaaattgatacagttgtatggaagacagtatgrcgattcctgaaaaaactaggaataaaacaaccatatgacccaacaatcccactattaggcacatactctgagaaaaccataattgaaaaagacatgtctc

SEQ ID NO: 119233 - DNA, 201 bp, Bos taurus
caacccagggatcaaacccaggtctcccgcattgcaggtagattctttaccagctgagccacaagtgaaggacatcacatacacatgcattgaaaagtccraggttcttgggacttccccagtggcccagtggttaagactctgctgccaatgcagggggcacagtttcaatgtctggttgaggatctaagatcctgcatg

SEQ ID NO: 119234 - DNA, 201 bp, Bos taurus; identical to SEQ ID NO: 38214

SEQ ID NO: 119235 - DNA, 201 bp, Bos taurus
atcaacagggtttgatgtcacaacagcacaaaaactgagaatggaacagtgccacagtgctgatgaaaagacccgtcagctgcttttccttcctctgctgkttttaataaatctgttttattcagatttctctttcagcctctacatctgagccatcttttgctcaggaataaattacatttgtcccatgaaatttatgag

SEQ ID NO: 119236 - DNA, 201 bp, Bos taurus
taggcccgttcacatatgggcaactgacttctgacaaaagcaccacggtaatgtagtggggagaaagctctccaacaagtggtgctggaggaactgggtayccagagggagagaaataaaccttgactcatacctcacaacatacacaaaaattaatttgaatcacagacctaaatttaaaaaactaaaactataaaattt

SEQ ID NO: 119237 - DNA, 201 bp, Bos taurus; identical to SEQ ID NO: 38219

SEQ ID NO: 119238 - DNA, 201 bp, Bos taurus
ttgtccccgccttccacgcctgccctgcaggttctcggctcctcctggagcccggggaaggggtccccgtgccacaagttctacctcagcacccagccacytggcaccgtgcagggcccacctcttccttttctcttatttagctctgcttagaaacacactgcactccaaatggtgaataggattggaaattagaattac

SEQ ID NO: 119239 - DNA, 201 bp, Bos taurus; identical to SEQ ID NO: 78127

SEQ ID NO: 119240 - DNA, 201 bp, Bos taurus
gggagcgtcctctgacctacgctggagggaagtgggtcagcggagcagggggagcgcagcagtgtcggagtgctcacggccaacattcagagataaagcayctgttgtcgcacagacgcaaatgagtgagtgtcaccctcactctccagagttgggcttttttcctgaacattcctggggggcctgtgccggctgagcggg

SEQ ID NO: 119241 - DNA, 201 bp, Bos taurus
gtcctggctgtcagcggggctggaggcaggacaggaggacccaggcaggggaccggcaggcgcccaggcctggcggagcaggtgggccggccagtggtcaygtgtcctctactggtggtccttaagcgcctgcttcacagtcccctggacagattatttcaaatgcagactcctggatgccgcgtctctgggcccggcccg

SEQ ID NO: 119242 - DNA, 201 bp, Bos taurus
gcagcccagggctcactcgctggtgaagcctccagatggcctttggagcacccactgtgggccaggcccctgctgaggatgggggcaaggaggtgcggccrgtttacctctacccaggaaagagctcagacccagtggacagatacgcacagcaaactaagggaggtcagggctcaggggccagcagggaggggaccacct

SEQ ID NO: 119243 - DNA, 201 bp, Bos taurus; identical to SEQ ID NO: 38223

SEQ ID NO: 119244 - DNA, 201 bp, Bos taurus; identical to SEQ ID NO: 38224

SEQ ID NO: 119245 - DNA, 201 bp, Bos taurus; identical to SEQ ID NO: 78129

SEQ ID NO: 119246 - DNA, 201 bp, Bos taurus
gtgcagaggttgactcggcggagggtgcacggttcctgccaaagacgtcactcagggctgttaaagtggggcgtttacgccctgccacggcatgtgtcccrcttggccactgccttacgggacccggcagggctctgtcacccccattttacaggggaacttactgagacagattgtcatgcggccaaggccacccagtga

SEQ ID NO: 119247 - DNA, 201 bp, Bos taurus; identical to SEQ ID NO: 78131

SEQ ID NO: 119248 - DNA, 201 bp, Bos taurus; identical to SEQ ID NO: 38225

SEQ ID NO: 119249 - DNA, 201 bp, Bos taurus; identical to SEQ ID NO: 38226

SEQ ID NO: 119250 - DNA, 201 bp, Bos taurus; identical to SEQ ID NO: 78135

SEQ ID NO: 119251 - DNA, 201 bp, Bos taurus; identical to SEQ ID NO: 38229

SEQ ID NO: 119252 - DNA, 201 bp, Bos taurus; identical to SEQ ID NO: 78137

SEQ ID NO: 119253 - DNA, 201 bp, Bos taurus; identical to SEQ ID NO: 78138

SEQ ID NO: 119254 - DNA, 201 bp, Bos taurus; identical to SEQ ID NO: 38230

SEQ ID NO: 119255 - DNA, 201 bp, Bos taurus; identical to SEQ ID NO: 78140

SEQ ID NO: 119256 - DNA, 201 bp, Bos taurus; identical to SEQ ID NO: 38236

SEQ ID NO: 119257 - DNA, 201 bp, Bos taurus; identical to SEQ ID NO: 38240

SEQ ID NO: 119258 - DNA, 201 bp, Bos taurus; identical to SEQ ID NO: 78150

SEQ ID NO: 119259 - DNA, 201 bp, Bos taurus
ccatgctttacctgagtgcctcaatcttctggtgacttggaagaaatggctgagcatcaggctccagcaaatcccaagtgcccatccctggaccagcaaaktgactagcatcagaagcccatgggaggtgctgaaattacagaggcttaagccccacctccagtgttgttgcctggagaatcccagggacggggagcctgg

SEQ ID NO: 119260 - DNA, 201 bp, Bos taurus; identical to SEQ ID NO: 38243

SEQ ID NO: 119261 - DNA, 201 bp, Bos taurus; identical to SEQ ID NO: 78151

SEQ ID NO: 119262 - DNA, 201 bp, Bos taurus; identical to SEQ ID NO: 78153

SEQ ID NO: 119263 - DNA, 201 bp, Bos taurus; identical to SEQ ID NO: 78154

SEQ ID NO: 119264 - DNA, 201 bp, Bos taurus; identical to SEQ ID NO: 78155

SEQ ID NO: 119265 - DNA, 201 bp, Bos taurus; identical to SEQ ID NO: 78156

SEQ ID NO: 119266 - DNA, 201 bp, Bos taurus; identical to SEQ ID NO: 78159

SEQ ID NO: 119267 - DNA, 201 bp, Bos taurus; identical to SEQ ID NO: 78160

SEQ ID NO: 119268 - DNA, 201 bp, Bos taurus; identical to SEQ ID NO: 78161

SEQ ID NO: 119269 - DNA, 201 bp, Bos taurus; identical to SEQ ID NO: 38251

SEQ ID NO: 119270 - DNA, 201 bp, Bos taurus; identical to SEQ ID NO: 78166

SEQ ID NO: 119271 - DNA, 201 bp, Bos taurus; identical to SEQ ID NO: 78167

SEQ ID NO: 119272 - DNA, 201 bp, Bos taurus; identical to SEQ ID NO: 78168

SEQ ID NO: 119273 - DNA, 201 bp, Bos taurus; identical to SEQ ID NO: 78169

SEQ ID NO: 119274 - DNA, 201 bp, Bos taurus; identical to SEQ ID NO: 38253

SEQ ID NO: 119275 - DNA, 201 bp, Bos taurus; identical to SEQ ID NO: 78174

SEQ ID NO: 119276 - DNA, 201 bp, Bos taurus; identical to SEQ ID NO: 38256

SEQ ID NO: 119277 - DNA, 201 bp, Bos taurus; identical to SEQ ID NO: 78177

SEQ ID NO: 119278 - DNA, 201 bp, Bos taurus; identical to SEQ ID NO: 38260

SEQ ID NO: 119279 - DNA, 201 bp, Bos taurus; identical to SEQ ID NO: 38261

SEQ ID NO: 119280 - DNA, 201 bp, Bos taurus
caagtttgaagatgttgaagggagggccactggtgggaggggacaggaacgaggggaaacttcaggaagagagaggaatggtgaaagtagtggaggaatgrtagggctggacagggaggcctggcgagctgcgattcacggggtcacaaagagtcggacacgactgagggactgaactgaactgaactgatgcttttacat

SEQ ID NO: 119281 - DNA, 201 bp, Bos taurus
ctgagacaatagagagtggtggtgtttgtggcccacgggagaggaggtacatggcaataatgctcccatggaagcagcaacccgctactggctaaacgaamagatctgaccaggccacagggcctctggtcggcaaacctgcaaagggctgttccaccagggaaaatattcacactatttaaccacgggaatcccggttat

SEQ ID NO: 119282 - DNA, 201 bp, Bos taurus; identical to SEQ ID NO: 38272

SEQ ID NO: 119283 - DNA, 201 bp, Bos taurus; identical to SEQ ID NO: 38273

SEQ ID NO: 119284 - DNA, 201 bp, Bos taurus; identical to SEQ ID NO: 38275

SEQ ID NO: 119285 - DNA, 201 bp, Bos taurus
agcatgtgctgagctcgttacttgcagtatgacctttagttcttcaataaccccctgaggatgtgctgttttttcctgtacagaccagaagcagaggccaygctaatcagtactatctctctagagcctgcattctcaatggggtgaagtcacccccaggggggtaaaaattggcccttgggaggacaggggtaaaaaaaa

SEQ ID NO: 119286 - DNA, 201 bp, Bos taurus; identical to SEQ ID NO: 38277

SEQ ID NO: 119287 - DNA, 201 bp, Bos taurus
ttggttcagaagaggccagttctagagaggcacttaccacaggggcggtgagcttgcgtctcaggaggatgtggcaggtgaatgtcagcacaatggcaatrgtcgatgcaatgggggccaatgctgagtttccactctggacaaatccagctttttccagtaacttcctttccttcttccttatacctagtaaatagaaat

SEQ ID NO: 119288 - DNA, 201 bp, Bos taurus; identical to SEQ ID NO: 78197

SEQ ID NO: 119289 - DNA, 201 bp, Bos taurus; identical to SEQ ID NO: 78198

SEQ ID NO: 119290 - DNA, 201 bp, Bos taurus; identical to SEQ ID NO: 38278

SEQ ID NO: 119291 - DNA, 201 bp, Bos taurus; identical to SEQ ID NO: 38279

SEQ ID NO: 119292 - DNA, 201 bp, Bos taurus; identical to SEQ ID NO: 78199

SEQ ID NO: 119293 - DNA, 201 bp, Bos taurus; identical to SEQ ID NO: 38280

SEQ ID NO: 119294 - DNA, 201 bp, Bos taurus
gatttatttatttgtgtgtctatggccgtgctgagttttcagtgctgcaccggcttttctctggttgcagtgagaggcctactcaggctgctcactagttrtggtgtgcgggcttctcgtttgttgcggagcacgggctctagggtgcatgggcctcagtggctgcagctcctggggctctagagctcaggctcagtagtt

SEQ ID NO: 119295 - DNA, 201 bp, Bos taurus
gtggctgccagtggaagaattcatggacagcctggcaagtctccccgggagtctggaaatgtacagaagcagagagactggaaccaacacctggccagacrtgctgaaggtgagaggctgctggagcagcctgtcccagtggatacagtgaaagagggttgtagagctgtaggcactttgcaccactgagtggccaggatg

SEQ ID NO: 119296 - DNA, 201 bp, Bos taurus; identical to SEQ ID NO: 38285

SEQ ID NO: 119297 - DNA, 201 bp, Bos taurus
tgggcaggttctcctcatgagataccaaagtagtatcaaagtggactatgggcccagctctgtgaaaagagaacttctacggccaatagtttcaaagtttyagagtttacccttattggaagagttgagatcatctcctcacccttgagcagctcgctgtggccaaggcgagggaatgtgatgattggctaagcctacctt

SEQ ID NO: 119298 - DNA, 201 bp, Bos taurus; identical to SEQ ID NO: 38287

SEQ ID NO: 119299 - DNA, 201 bp, Bos taurus; identical to SEQ ID NO: 38288

SEQ ID NO: 119300 - DNA, 201 bp, Bos taurus; identical to SEQ ID NO: 38289

SEQ ID NO: 119301 - DNA, 201 bp, Bos taurus; identical to SEQ ID NO: 38291

SEQ ID NO: 119302 - DNA, 201 bp, Bos taurus; identical to SEQ ID NO: 38293

SEQ ID NO: 119303 - DNA, 201 bp, Bos taurus
taagagaatgctctgcaactttactgcatcgtcaaaaagttcacaggagagaatgtgtgaataaagactaaaccttcttagcagtagtaaatataaagttyagtagaatagtgtgtgaaaatttcatatttaataaaacagttcatcttctgagatttatgaattattagatatttaaaacgagcatgtgaatatgggaag

SEQ ID NO: 119304 - DNA, 201 bp, Bos taurus; identical to SEQ ID NO: 78213

SEQ ID NO: 119305 - DNA, 201 bp, Bos taurus
acagaagatgaatgatacacgaacaatttgtatgccaggcaactgtgtgctagataattagacattaaagtaagcataataatctcagagataaaggatgrtgttagaagcatgaagcagcaacaggcattaacaaaagaaaagcaattggaaatgttagatctggaagatataatgggtaaaattaacaagcttagtaga

SEQ ID NO: 119306 - DNA, 201 bp, Bos taurus
ggcctctcaccatggggtagtggccagaggcggtggccgctgggctgggggaaggacaggagagtggacaggggagatggcactctggccccggtgctgcygtgactgcctgcacttcctctctggtcctccgtttcctcgtgggtgaaggaaacctttgctaccagctccctcccaaggctgtccagggggccaaaatgg

SEQ ID NO: 119307 - DNA, 201 bp, Bos taurus; identical to SEQ ID NO: 78214

SEQ ID NO: 119308 - DNA, 201 bp, Bos taurus; identical to SEQ ID NO: 38295

SEQ ID NO: 119309 - DNA, 201 bp, Bos taurus; identical to SEQ ID NO: 38296

SEQ ID NO: 119310 - DNA, 201 bp, Bos taurus; identical to SEQ ID NO: 38299

SEQ ID NO: 119311 - DNA, 201 bp, Bos taurus; identical to SEQ ID NO: 38301

SEQ ID NO: 119312 - DNA, 201 bp, Bos taurus; identical to SEQ ID NO: 38302

SEQ ID NO: 119313 - DNA, 201 bp, Bos taurus; identical to SEQ ID NO: 38304

SEQ ID NO: 119314 - DNA, 201 bp, Bos taurus
taccactacagccgacttatttaatcttttcttggctacagtgacacacagaatagagcaactagaacctgctgtagacagaggccagttctcatggaagraggcacagcgcaaatctatggggcaactggaaaccgtgctgcagttactgagcacaggacacaaaaacattagcctgtcatcaccaggccttctccctgc

SEQ ID NO: 119315 - DNA, 201 bp, Bos taurus
attgttaacgacacgccattgttgtaatttgaacttggtaaatgcaattttttggctgtttgctctctcttggttttctctcctgggttcctggacccctrtgttccttggcaggggtgtgtgtggggggtgtatttccttttcaacaccacaaataccatctctgctattgggacacaacagttaaataatgtgaaattg

SEQ ID NO: 119316 - DNA, 201 bp, Bos taurus; identical to SEQ ID NO: 78220

SEQ ID NO: 119317 - DNA, 201 bp, Bos taurus; identical to SEQ ID NO: 78221

SEQ ID NO: 119318 - DNA, 201 bp, Bos taurus; identical to SEQ ID NO: 78224

SEQ ID NO: 119319 - DNA, 201 bp, Bos taurus; identical to SEQ ID NO: 78225

SEQ ID NO: 119320 - DNA, 201 bp, Bos taurus; identical to SEQ ID NO: 78226

SEQ ID NO: 119321 - DNA, 201 bp, Bos taurus
ccttaaagcacattaacctgccaatcctcagttttactgagaagaaacttattagatctcagttgacattttattacctatttgctaccacacttattttkttatcattttaaagtagttattccatttttaaatcactaaaactcagcgcatcaacagcagtgtggatggcagatgtatctcctacagaggtttgccaga

SEQ ID NO: 119322 - DNA, 201 bp, Bos taurus; identical to SEQ ID NO: 38309

SEQ ID NO: 119323 - DNA, 201 bp, Bos taurus; identical to SEQ ID NO: 38311

SEQ ID NO: 119324 - DNA, 201 bp, Bos taurus; identical to SEQ ID NO: 38312

SEQ ID NO: 119325 - DNA, 201 bp, Bos taurus; identical to SEQ ID NO: 38313

SEQ ID NO: 119326 - DNA, 201 bp, Bos taurus; identical to SEQ ID NO: 38315

SEQ ID NO: 119327 - DNA, 201 bp, Bos taurus; identical to SEQ ID NO: 38316

SEQ ID NO: 119328 - DNA, 201 bp, Bos taurus; identical to SEQ ID NO: 38317

SEQ ID NO: 119329 - DNA, 201 bp, Bos taurus
tctgctctgcgatgttcctcgcaaacctgatacctgtctcccatttggtggatttgagtcacggtgtttttgtttaagacttcaactgcagctccttctcratctttgtttcatgtatgtaatatacttaaaatgcactaaatgacagtttataatatcattatctacagttaaagatattataacttcaaaaatgaaaag

SEQ ID NO: 119330 - DNA, 201 bp, Bos taurus
aggccagagtctgtgtccctgttagaggttggggtcagagggcgacaccgtggacaggcgaggtggagggacaaacgtggcccagggagccctcgtcgaaygcagggcatcttggcggctaatgactcggggtggagtcggggggtcttggctttggaatcggggcgggtgggaactccagcggcctggctgccaagcaac

SEQ ID NO: 119331 - DNA, 201 bp, Bos taurus; identical to SEQ ID NO: 38318

SEQ ID NO: 119332 - DNA, 201 bp, Bos taurus; identical to SEQ ID NO: 38319

SEQ ID NO: 119333 - DNA, 201 bp, Bos taurus
aggtttaatccctggtgggataactaagacctaagactccacaagccctgcagctttaaaaaaaaaaaggaaatcgaaacaggaaacagagtggagagccytggtggccttggaccaggctcactggacattgttgaagacagcaagaccagtttccgaaaccacccacaggtaagagggggatcctaagttctttccagg

SEQ ID NO: 119334 - DNA, 201 bp, Bos taurus; identical to SEQ ID NO: 38322

SEQ ID NO: 119335 - DNA, 201 bp, Bos taurus; identical to SEQ ID NO: 38324

SEQ ID NO: 119336 - DNA, 201 bp, Bos taurus
cccggaaactctgaggctccccactctgggaaggatggtccccagtggcacttagaaacagcagagatctgcctccttcttgccgccccaatcaggccacrtcagctttgccatctcctcgttctggctccaccaccacgaaatgacccacatttctctcgggaagttatctctcatgcctgtggtagagccagagagaga

SEQ ID NO: 119337 - DNA, 201 bp, Bos taurus; identical to SEQ ID NO: 38327

SEQ ID NO: 119338 - DNA, 201 bp, Bos taurus; identical to SEQ ID NO: 78248

SEQ ID NO: 119339 - DNA, 201 bp, Bos taurus; identical to SEQ ID NO: 38330

SEQ ID NO: 119340 - DNA, 201 bp, Bos taurus; identical to SEQ ID NO: 38332

SEQ ID NO: 119341 - DNA, 201 bp, Bos taurus; identical to SEQ ID NO: 38333

SEQ ID NO: 119342 - DNA, 201 bp, Bos taurus; identical to SEQ ID NO: 38334

SEQ ID NO: 119343 - DNA, 201 bp, Bos taurus; identical to SEQ ID NO: 78256

SEQ ID NO: 119344 - DNA, 201 bp, Bos taurus; identical to SEQ ID NO: 78257

SEQ ID NO: 119345 - DNA, 201 bp, Bos taurus; identical to SEQ ID NO: 38336

SEQ ID NO: 119346 - DNA, 201 bp, Bos taurus; identical to SEQ ID NO: 78261

SEQ ID NO: 119347 - DNA, 201 bp, Bos taurus; identical to SEQ ID NO: 38338

SEQ ID NO: 119348 - DNA, 201 bp, Bos taurus; identical to SEQ ID NO: 78262

SEQ ID NO: 119349 - DNA, 201 bp, Bos taurus; identical to SEQ ID NO: 78263

SEQ ID NO: 119350 - DNA, 201 bp, Bos taurus
ttggcttcttttagtttagttttgttttttttttcccctattataaacggcactggggtgagctttcttagagataaatcattagatgctagtttccctamggaaagcatatggtttccttaggaaatttctcccagggagaggactactgagtccaagagtaagaaccttttaaatgattctaattcagttctgtaaagc

SEQ ID NO: 119351 - DNA, 201 bp, Bos taurus; identical to SEQ ID NO: 38343

SEQ ID NO: 119352 - DNA, 201 bp, Bos taurus
agaccaggtagggacaggccgggataaggtgcggcaagggccggctgaccccgagcgggcgtggtacagaggatgacaggttgcagagccctgcagcgagygagtagggttctgccgcggtggggcccttggggacccagattccaccctccaccaacctgtacctccttccacctacctgcggtctttctagccccggcc

SEQ ID NO: 119353 - DNA, 201 bp, Bos taurus; identical to SEQ ID NO: 38344

SEQ ID NO: 119354 - DNA, 201 bp, Bos taurus
ctcattggcaggtggattcttcaccactagcgccacctgggaagcccctaatggtggacacatgtcattatattatgtgtgatgtatacatatttaggttrcatgtattataaggttgcagatagaataggtggcagagatcagacttaaacccatgactttctgactacaaagtctacgatcttttttctgaaccaggct

SEQ ID NO: 119355 - DNA, 201 bp, Bos taurus
gtaccacaaactgagtgacttagaacaacagaaacctattgtttcactgtcctgaattcaagaagcctaaaaccaggatgttggctttctgaaggcaccakggaaggatttgctttaggcttcctagcttcctcaggcattcttggcttgtaaagcgccatcttctctctatctcttcacatcattcctctctctgtgtgt

SEQ ID NO: 119356 - DNA, 201 bp, Bos taurus; identical to SEQ ID NO: 78276

SEQ ID NO: 119357 - DNA, 201 bp, Bos taurus; identical to SEQ ID NO: 78277

SEQ ID NO: 119358 - DNA, 201 bp, Bos taurus; identical to SEQ ID NO: 38348

SEQ ID NO: 119359 - DNA, 201 bp, Bos taurus; identical to SEQ ID NO: 78278

SEQ ID NO: 119360 - DNA, 201 bp, Bos taurus; identical to SEQ ID NO: 38350

SEQ ID NO: 119361 - DNA, 201 bp, Bos taurus
catttcatctggtgcataaagagttaattagtgagagattttcaagtggcagtatatttaagacagagcaaggagccatttacagtgtcctcactttttcraaagtgctgtatgagaaggccacaagggcagatagatagagtatatgggtatatgcttgtgcaagttggggtaggagacaaaattgggggtaaattatga

SEQ ID NO: 119362 - DNA, 201 bp, Bos taurus; identical to SEQ ID NO: 38351

SEQ ID NO: 119363 - DNA, 201 bp, Bos taurus
ccccacccagagacatttttatgatggccattctgatctataggagtgctatctcattgtggtttttatttgcatttatctaataattggtaatattgaayatttttggtgtctactggccaactgtatgtattctttggagaaatatctatttaggtcttctgcccattttttgattgtgttttttttttgttgttgttg

SEQ ID NO: 119364 - DNA, 201 bp, Bos taurus
tgccaactactgcccctgccttcttgggagcaggcatggcccaactccatcacagtcaagggtcttatgacctagtgccagctgctgctcccacctagctkggagaatgtgtggcctttctttgccaagggcccctacaaccaggagtcaacctctgcctccacctccttgggaatgcacacaggccatgtacctgcacat

SEQ ID NO: 119365 - DNA, 201 bp, Bos taurus; identical to SEQ ID NO: 78284

SEQ ID NO: 119366 - DNA, 201 bp, Bos taurus
actgtggctccactggccaatatgatcaatttattttatcagtaaataaagataaaatatttatcatgacctgtaactagagttaagtgaaatgaataacrggcctctcactttttgtggggccatagctagtacattgtaaataaactgatttaagtattatttatgtcccatctacctaaaaggaatatcttcagacac

SEQ ID NO: 119367 - DNA, 201 bp, Bos taurus
aaacctcattcctctagtttaatgcatatgtggccttggatagcattgttgaaccacagtgttgtctgtctctttctttctctaataaaataataataatrttattattatctcagaaggcctggtcttctgagaagcataagctaagagtggataaaatgggtaaggattatttttaaactttatttttaattttatttt

SEQ ID NO: 119368 - DNA, 201 bp, Bos taurus; identical to SEQ ID NO: 78287

SEQ ID NO: 119369 - DNA, 201 bp, Bos taurus; identical to SEQ ID NO: 38353

SEQ ID NO: 119370 - DNA, 201 bp, Bos taurus; identical to SEQ ID NO: 38354

SEQ ID NO: 119371 - DNA, 201 bp, Bos taurus; identical to SEQ ID NO: 38355

SEQ ID NO: 119372 - DNA, 201 bp, Bos taurus; identical to SEQ ID NO: 38356

SEQ ID NO: 119373 - DNA, 201 bp, Bos taurus; identical to SEQ ID NO: 38357

SEQ ID NO: 119374 - DNA, 201 bp, Bos taurus; identical to SEQ ID NO: 38358

SEQ ID NO: 119375 - DNA, 201 bp, Bos taurus; identical to SEQ ID NO: 78297

SEQ ID NO: 119376 - DNA, 201 bp, Bos taurus
tttgactcataataatgttatattattttaaattgatacataataaaccaaaagtaagtaatctatctatccaaaatatgtttcccatttagttggccttrtgcttttctcaagtaaagacaaagatttgactcaaacttcaaaagatttgaagtttgactcaaacttcaaaaactggggctaaatataaactaggataaa

SEQ ID NO: 119377 - DNA, 201 bp, Bos taurus; identical to SEQ ID NO: 38362

SEQ ID NO: 119378 - DNA, 201 bp, Bos taurus; identical to SEQ ID NO: 38364

SEQ ID NO: 119379 - DNA, 201 bp, Bos taurus; identical to SEQ ID NO: 38366

SEQ ID NO: 119380 - DNA, 201 bp, Bos taurus; identical to SEQ ID NO: 38367

SEQ ID NO: 119381 - DNA, 201 bp, Bos taurus; identical to SEQ ID NO: 38368

SEQ ID NO: 119382 - DNA, 201 bp, Bos taurus; identical to SEQ ID NO: 38369

SEQ ID NO: 119383 - DNA, 201 bp, Bos taurus
attgaggacttaagttttgtgataatcactgcatgttagtactttcaagaagaaaacagtctccgtttcctcataaatttgctgacagtgaaagcaagtgygaggccatgaggacgagggtgacacagctgtgggaccccacaaagatcctctggtgtgatttcctgccatcagctgttcagagtcagtggaggtctacac

SEQ ID NO: 119384 - DNA, 201 bp, Bos taurus
aagcttgaaaaggaattcagatgcctcaaagggaaaggattagtagcaaagtaacatactatctggatttagggacactgttcaggatatgtatgaaagayggatcgtgctggagttgacagagcgaaaagtaaccctggaagcataaagatctgtgaggtggcaactgcagcaaaatcttggagaaagggattctggctt

SEQ ID NO: 119385 - DNA, 201 bp, Bos taurus; identical to SEQ ID NO: 38373

SEQ ID NO: 119386 - DNA, 201 bp, Bos taurus
tgttaagtgactacaagaacagatcatgcacagactttcaatgaatgcctctgaaggaagccaacattgaattccattttaaacagacaaagctgtcataygattgaagtaattctctgaactttcctggcccagagtgctgtgccaacagccagagagcttctacaacccagaggaggaaaccttgcaggagactcatag

SEQ ID NO: 119387 - DNA, 201 bp, Bos taurus; identical to SEQ ID NO: 78312

SEQ ID NO: 119388 - DNA, 201 bp, Bos taurus; identical to SEQ ID NO: 38375

SEQ ID NO: 119389 - DNA, 201 bp, Bos taurus; identical to SEQ ID NO: 38376

SEQ ID NO: 119390 - DNA, 201 bp, Bos taurus
tggaatgcttttacaattacagagtaactcaattcagatggtacatttttattagaaagacccaatctatatttagatctcctttctctctggggccatawatttagtgacttctcagaactcaaaagaccagacccaccattttggctgcaaaggacagagtcaaatagcaatcgttccccctctttcctgggagcatcc

SEQ ID NO: 119391 - DNA, 201 bp, Bos taurus
cagtgctacacaatccacagtgcatttgaatccaaggatgaaaaaccgctgatggggaggaaccgtggatatggagggccgaacagaaattttgtgtgcgytttcccttgcaaagagggttgacacccctagcccttgactgttcaagggcccgctatgcagctatggccccaggacagggaggatcccttgaacaaaatg

SEQ ID NO: 119392 - DNA, 201 bp, Bos taurus
tctagctcaccttcttctcattggaatggatgacacagactaatgaagacgtatccgtgatataagtcacaagccattatgaatcccactacccagccacytggccaagatgccttctggctcaacctcaggcatgagaagtcccacccagcaagtagaggtgcctgggaatgaaacaggctcacgggaatggacagctgg

SEQ ID NO: 119393 - DNA, 201 bp, Bos taurus
cttctcaggggaggcccaaggaggtggaggccagagggctggaggcccagatcatcatacggggcacagtgtctgttcctggtccttaccctccatgagcyacaccttcctccccttctggcctccctgcctccagtctggcccagacaatttcccttcctcagagaagtctttgccaagcacttccaggccccgccttga

SEQ ID NO: 119394 - DNA, 201 bp, Bos taurus
ggaatggtcaaaacttcaattgcctccttggtacctgaccccacttatcttgctgctgaacacctccaagagtaagtctcaagacccaatgagttgggagmaaaatatcctttaatatagaccaggataacatgggcttttcaccctcagtgtccttacagagagccacttccattattgctctggatttttcttaaagaa

SEQ ID NO: 119395 - DNA, 201 bp, Bos taurus
actccactgggaaaaaaaaactttccatgtgagggagtgcacaaactcatctctctcttttccctcctcacagcaaagcagaaggccatctctcacccgcrgtctcattatgctggcatcagctcaggagaggtgtgtacgtgtgtcagtcaggagaggccgaggcatgctgctgcaacaagtgcccccactctcccataa

SEQ ID NO: 119396 - DNA, 201 bp, Bos taurus; identical to SEQ ID NO: 38380

SEQ ID NO: 119397 - DNA, 201 bp, Bos taurus; identical to SEQ ID NO: 38381

SEQ ID NO: 119398 - DNA, 201 bp, Bos taurus; identical to SEQ ID NO: 38382

SEQ ID NO: 119399 - DNA, 201 bp, Bos taurus; identical to SEQ ID NO: 38383

SEQ ID NO: 119400 - DNA, 201 bp, Bos taurus; identical to SEQ ID NO: 38384

SEQ ID NO: 119401 - DNA, 201 bp, Bos taurus; identical to SEQ ID NO: 38385

SEQ ID NO: 119402 - DNA, 201 bp, Bos taurus; identical to SEQ ID NO: 38386

SEQ ID NO: 119403 - DNA, 201 bp, Bos taurus; identical to SEQ ID NO: 38387

SEQ ID NO: 119404 - DNA, 201 bp, Bos taurus; identical to SEQ ID NO: 38388

SEQ ID NO: 119405 - DNA, 201 bp, Bos taurus; identical to SEQ ID NO: 38389

SEQ ID NO: 119406 - DNA, 201 bp, Bos taurus; identical to SEQ ID NO: 38390

SEQ ID NO: 119407 - DNA, 201 bp, Bos taurus; identical to SEQ ID NO: 38391

SEQ ID NO: 119408 - DNA, 201 bp, Bos taurus; identical to SEQ ID NO: 38392

SEQ ID NO: 119409 - DNA, 201 bp, Bos taurus; identical to SEQ ID NO: 38393

SEQ ID NO: 119410 - DNA, 201 bp, Bos taurus; identical to SEQ ID NO: 38394

SEQ ID NO: 119411 - DNA, 201 bp, Bos taurus; identical to SEQ ID NO: 38395

SEQ ID NO: 119412 - DNA, 201 bp, Bos taurus; identical to SEQ ID NO: 38396

SEQ ID NO: 119413 - DNA, 201 bp, Bos taurus; identical to SEQ ID NO: 38397

SEQ ID NO: 119414 - DNA, 201 bp, Bos taurus; identical to SEQ ID NO: 78348

SEQ ID NO: 119415 - DNA, 201 bp, Bos taurus; identical to SEQ ID NO: 38402

SEQ ID NO: 119416 - DNA, 201 bp, Bos taurus
tccaggacagaaaaggagctcctgaaccaaacccgtattcttgcccttgcaaacttgacattcttgcaacaaagtctaggcaccgactagtggggtatttyagactgttttcttattactaaatggaaaggtattaacacaatgcagaaattttttaaaaatgcagagggtgaggggcggggggagagaaaagaaaagaca

SEQ ID NO: 119417 - DNA, 201 bp, Bos taurus; identical to SEQ ID NO: 38404

SEQ ID NO: 119418 - DNA, 201 bp, Bos taurus; identical to SEQ ID NO: 38406

SEQ ID NO: 119419 - DNA, 201 bp, Bos taurus; identical to SEQ ID NO: 78351

SEQ ID NO: 119420 - DNA, 201 bp, Bos taurus; identical to SEQ ID NO: 38407

SEQ ID NO: 119421 - DNA, 201 bp, Bos taurus; identical to SEQ ID NO: 38408

SEQ ID NO: 119422 - DNA, 201 bp, Bos taurus; identical to SEQ ID NO: 38409

SEQ ID NO: 119423 - DNA, 201 bp, Bos taurus; identical to SEQ ID NO: 38410

SEQ ID NO: 119424 - DNA, 201 bp, Bos taurus
atattgtattatctcacttatatatggaatctttttttttttttttttgagtcctactcagagtagaaagttgattaccaaagactaagggtgggaaaaarggggagacattaatcaaaggtgcaaaaattcagctatgacatgaattagttctggagactgaatgtacagcatggtgactgtagttaacaataatatact

SEQ ID NO: 119425 - DNA, 201 bp, Bos taurus; identical to SEQ ID NO: 38412

SEQ ID NO: 119426 - DNA, 201 bp, Bos taurus; identical to SEQ ID NO: 38416

SEQ ID NO: 119427 - DNA, 201 bp, Bos taurus; identical to SEQ ID NO: 38417

SEQ ID NO: 119428 - DNA, 201 bp, Bos taurus; identical to SEQ ID NO: 78363

SEQ ID NO: 119429 - DNA, 201 bp, Bos taurus; identical to SEQ ID NO: 78364

SEQ ID NO: 119430 - DNA, 201 bp, Bos taurus; identical to SEQ ID NO: 78365

SEQ ID NO: 119431 - DNA, 201 bp, Bos taurus; identical to SEQ ID NO: 38422

SEQ ID NO: 119432 - DNA, 201 bp, Bos taurus; identical to SEQ ID NO: 38423

SEQ ID NO: 119433 - DNA, 201 bp, Bos taurus; identical to SEQ ID NO: 78374

SEQ ID NO: 119434 - DNA, 201 bp, Bos taurus; identical to SEQ ID NO: 38428

SEQ ID NO: 119435 - DNA, 201 bp, Bos taurus; identical to SEQ ID NO: 38429

SEQ ID NO: 119436 - DNA, 201 bp, Bos taurus; identical to SEQ ID NO: 78375

SEQ ID NO: 119437 - DNA, 201 bp, Bos taurus; identical to SEQ ID NO: 38434

SEQ ID NO: 119438 - DNA, 201 bp, Bos taurus
atctgctctgtctgggattgggagcccggagttatcccctgatgttctgagggcccctaaaatgagctgtcaggagctctggagggtgtgaggggcagtgmggcaggaaggatgctcagacctgggccagggatgaccaatacattcaccctccagacagctccccactccctgtcgcttcagggtcctgcagaaggtgga

SEQ ID NO: 119439 - DNA, 201 bp, Bos taurus; identical to SEQ ID NO: 38435

SEQ ID NO: 119440 - DNA, 201 bp, Bos taurus; identical to SEQ ID NO: 38436

SEQ ID NO: 119441 - DNA, 201 bp, Bos taurus; identical to SEQ ID NO: 38437

SEQ ID NO: 119442 - DNA, 201 bp, Bos taurus; identical to SEQ ID NO: 38438

SEQ ID NO: 119443 - DNA, 201 bp, Bos taurus
tgccctcacagaccctgtgaagggcactggccacccttttgtaccaggtaatcccacccagtgacctgggtctggatgaagatcagaagtccaacaatccrtcaactggcctgtgacctctgacccagcatcaaaagataagctgagccaatatactctgaggaatgggagagtaagaaaaatgttgttgggttggggcag

SEQ ID NO: 119444 - DNA, 201 bp, Bos taurus
taacccaatccatttcaagtgaagggtagtgatttttccatatggatattcattggtttcatcaccatttgttgggagactatcctgttcccataaatcaycttggctcctttatcaagagtcaatggattgcttaagggtgggcctacaactggatactttatgctgtttcattagtctatatgggaattccaatgccag

SEQ ID NO: 119445 - DNA, 201 bp, Bos taurus
aaggatgttccagccagagaggacaacatatgcaaaagccctgaggctgaagcagcctattgaatgtgagagagagaaaaagaaagaaaaattcaggaagrcagtgggtaaagacttgattcccctgtgtaggactgatcctaccccatcacccatttggtgagcctaccttctcccacacctggggtccttgcataaacc

SEQ ID NO: 119446 - DNA, 201 bp, Bos taurus
agcactgttttagttatatctcataaattgcaatatgttctattttccatttttttttcacttcaaaatagtttctaatttcccttggtttaagttttaaytcatttgtgtctttgaatttagggtaagattctttgagacagaatatagttggataatactttatttttaaaatccactctgacaatcctctgccttcta

SEQ ID NO: 119447 - DNA, 201 bp, Bos taurus; identical to SEQ ID NO: 38439

SEQ ID NO: 119448 - DNA, 201 bp, Bos taurus
tatgggattcacgcggccccagtaatcctcggtttgtgggtggacttcagggtctctgcacacctctgaggtggaggccaggaatagacgggccccaactygctttgccagccccagcatgttcagtgtcccaacggtgttggtctttagtgtcttgaaggggttgtacatgtaactgggaggggaggcaggagaggccag

SEQ ID NO: 119449 - DNA, 201 bp, Bos taurus
tgaagaaactgcctccagacccttctgtgggcacatccatcaagatgacctatacttccttttccccaggactttctcagggaggcctggtagcaaatccygaaacctccagtgtttacagccccaagtgatattctgggctggctcctcctccctccactgctattagtgtcaattaagttcagcctgacaggccacctt

SEQ ID NO: 119450 - DNA, 201 bp, Bos taurus; identical to SEQ ID NO: 38441

SEQ ID NO: 119451 - DNA, 201 bp, Bos taurus
aattccttctttgatgaaactaaagagtcctgtaatctggaatcgcagtatatgaggaagggctgccaaattcagtgaaactcctaggagtgtagaaagaygctgagagaggaatctcaaagctgcagattttagaaaaacctgccaaagtttagtcctccaaactcactggcatatcctaggttggggggcgtggtggct

SEQ ID NO: 119452 - DNA, 201 bp, Bos taurus; identical to SEQ ID NO: 38442

SEQ ID NO: 119453 - DNA, 201 bp, Bos taurus
tggcccctcttcttcactgccctgctgtctgggtgaaggagcagccaaaggcattgttgctggagaaatgggaggtggcggcacctctggttttgtagttygggcccttgtgagcccacaggggccctagggactcagacttggaggaggcagagtgtttgggttgggtaccgttctgctgcctctgagcagccttctgag

SEQ ID NO: 119454 - DNA, 201 bp, Bos taurus
tctcctcacttggaatattcagttccatccacagagatggtatgtccaggcctgggcgatcacaagaggacagaaaagtgggcaaacctgggacctgtccrtgaagagtgattggaagaggcaggccagagaataggtcagtgctgtaagatgcagggggcaggggcccaggaacaggggtgtgatggtcagatgaggcta

SEQ ID NO: 119455 - DNA, 201 bp, Bos taurus
acccagggaggcctgtttcagatgggtggggccagaaggctagaaaaataataaacaaaaacaaaagtgaagagaagcaaagctcttgggtgccagaaagrggctggccaaggctgtggctgcctgagtaatgggttccacatttgcctggctctcagcaaccaggatccagaatgcacagtgggccctgcaggggccaga

SEQ ID NO: 119456 - DNA, 201 bp, Bos taurus
tttctcctgcgacgcagacggcctcgaaatgccattggtacctggagcagatcacatcccacttgtctcctgtgtggtatttacctgttaaaccggaatcyttcaccaaacctgttgtgcaactatctctttcaaatgtttgctgctctcctttcggccttgtttttggaaatccggtgggaataagggtgccagcttttt

SEQ ID NO: 119457 - DNA, 201 bp, Bos taurus
atttgggatttttttttcttttacataaaagtgagcattattttttaaagcaaaacctattttgctacaatatcatgggatgtgagagcacgttgagcagrgatttacagcaaacataggggacaaaagcatgatgggagcacccagtgttacactcttctgttcatactgtgaccaggctctgacttcataaaaggaaaa

SEQ ID NO: 119458 - DNA, 201 bp, Bos taurus
cacacatggattcctgaaccaatccctgtggctggggggagtgctgtgatttgactttacgtgcctgagtatgggaaccaatataagggaagaagaattarctttatactaatcaggcccacccgtggataaggggggtgagttcaagtttcccttaaacacagcaagctgcctgaggtaaggctgggtactgaagacaac

SEQ ID NO: 119459 - DNA, 201 bp, Bos taurus; identical to SEQ ID NO: 78400

SEQ ID NO: 119460 - DNA, 201 bp, Bos taurus; identical to SEQ ID NO: 78401

SEQ ID NO: 119461 - DNA, 201 bp, Bos taurus
gtctctgccttcagtggaagcctgccctgtgttttatgaaaccgtttttgctgtgagccttggactcccacgtaaagcattgaatgaaaccttggattcgrtcgatgctaatgaagctgaaaaagcagcctttggaaaactctgggattgcttcattgaagcagaacctgaagacaggtttaatcatctgaaatataaggt

SEQ ID NO: 119462 - DNA, 201 bp, Bos taurus
ggtttcacctcagaaagcttcagtgcccagatggtaatgctgctggctcatacctttccctggcaccagggcatggagaggggctggatatggccagggargaggtagcatcgggagctctgaactactgtatgaggaggagaggaaggaaaaacatgtcctttatagcagctgcctgaaaggaagacgctggggggtctt

SEQ ID NO: 119463 - DNA, 201 bp, Bos taurus
gggagggtggcaattgtcccagccacaccccttcccagctggaagccctggggggctgggcacccttcccgcaggggagggacaggcctgccaactgctcrtcccaagaaactggacccagggcagggcaggctcgggcgtgctaagttaaccctggggtgcagggcagagctggccccttgccacagtgaggacagacct

SEQ ID NO: 119464 - DNA, 201 bp, Bos taurus; identical to SEQ ID NO: 78403

SEQ ID NO: 119465 - DNA, 201 bp, Bos taurus
cgcttcctctagccctccacacagctagctaaggctcccttttcttcttcaggcctcagatcaaataatgactgtcaggagaggccttcttgagtccccarcaagagaagccacacatagatctaggcatggtcccatgactgagttttgtggttttattttgtttatcacaaatgaaagacaactccctgagggcagagg

SEQ ID NO: 119466 - DNA, 201 bp, Bos taurus
taggggcagggacaataggttggcctttttctggggtaatccaaaaatattcatcccatatctgttaaaactgttcaaatcacctgatggattggcccttytcactggctattgagttctcattctttttactttttaagtaaaaggtataggctttggtcccttttgtaaggcttgtatttacctcaagtgtcaccccat

SEQ ID NO: 119467 - DNA, 201 bp, Bos taurus; identical to SEQ ID NO: 78412

SEQ ID NO: 119468 - DNA, 201 bp, Bos taurus; identical to SEQ ID NO: 78413

SEQ ID NO: 119469 - DNA, 201 bp, Bos taurus; identical to SEQ ID NO: 78414

SEQ ID NO: 119470 - DNA, 201 bp, Bos taurus; identical to SEQ ID NO: 78415

SEQ ID NO: 119471 - DNA, 201 bp, Bos taurus; identical to SEQ ID NO: 78417

SEQ ID NO: 119472 - DNA, 201 bp, Bos taurus; identical to SEQ ID NO: 78420

SEQ ID NO: 119473 - DNA, 201 bp, Bos taurus; identical to SEQ ID NO: 78421

SEQ ID NO: 119474 - DNA, 201 bp, Bos taurus; identical to SEQ ID NO: 78422

SEQ ID NO: 119475 - DNA, 201 bp, Bos taurus; identical to SEQ ID NO: 78423

SEQ ID NO: 119476 - DNA, 201 bp, Bos taurus; identical to SEQ ID NO: 78425

SEQ ID NO: 119477 - DNA, 201 bp, Bos taurus; identical to SEQ ID NO: 78426

SEQ ID NO: 119478 - DNA, 201 bp, Bos taurus; identical to SEQ ID NO: 78427

SEQ ID NO: 119479 - DNA, 201 bp, Bos taurus
acattgcagcgatatgagctcaagggccggctaccccgctcaggttcacaagacagccagcaccgagaccccgcggccctcacagctggcccaggccagcrccttccagctctccacctctgtccccaagtccttcttctccaagcagcccgtgcgcagcaagcaccccacggggtggaagaggacagacgagccccctcc

SEQ ID NO: 119480 - DNA, 201 bp, Bos taurus
gcccgctgcctcacatccgccccctctgtccaccccactcccagcctccagcctgccctgtctgcccccgggtctcctcctctgcaggttcctaaattacrtgccggtgcccctgacatttctctctcacctcgcccctggcaggccccggggcaggactgtctggggacccagcggtgactggagcccgagccctgtcct

SEQ ID NO: 119481 - DNA, 201 bp, Bos taurus; identical to SEQ ID NO: 78428

SEQ ID NO: 119482 - DNA, 201 bp, Bos taurus; identical to SEQ ID NO: 78430

SEQ ID NO: 119483 - DNA, 201 bp, Bos taurus
agatggttggatggatggaagaatgcaagaatggatggatgaatggataggtgggtagatagaagggtggatggatggatggatggcctaggctggagtgratcaggtaggttttgaaagctccctgagtgattccagtttctgaccagggctgctcatgcgcaaaggtgtccagacagacagaaggtgaatgcacccgtg

SEQ ID NO: 119484 - DNA, 201 bp, Bos taurus
ccgccacggggctcttgctggaaatctcagctgccaaggtgaaagccgcatcaagcatgctctccttgtctgggaagagccggctgaggatgaaaggaatmggaaatcaggcaatctgagaagagctctcctctccctcccatggatgaagaagtgaccaatcgcagtagaaagtggaagacagcactggtgaaatggacc

SEQ ID NO: 119485 - DNA, 201 bp, Bos taurus
aacatgtatttaagaaaaaacgtcttggccacttcatgtgcagctggcaggatcttagttccccaaccagggactgaacctgggcccctgcagtgaaagcrccaaatcctaacattggacttgatacggaattcccagaaagcatgtaattatcacaacacattttattgacacccaaaaaaagactgagaggtcaagggc

SEQ ID NO: 119486 - DNA, 201 bp, Bos taurus
ggggaccacgctgggggcgcgtgtgggctctaggacaggctgcctgtgttggaaacccaactctgcaactcgagaggagcgcggcctcctatgggtgactkcgttttttctgaggctccgagctcctcctctcacaagtggagctcggaggactgaggaaggccacctggagggctgtgagcagtgagttccaatgtgagg

SEQ ID NO: 119487 - DNA, 201 bp, Bos taurus
agggtagggttccccctccctcgccccagtgatcaagggccactcactcgaacgaagtcacgaagcaggtctgggaaggagcgcccggcatcattatgagrttcttttccacggcccagccattcccgccgtgctccacctcccagcctctgaagccctctgtgggatataatagggttaaacacgggggattcgcgctcc

SEQ ID NO: 119488 - DNA, 201 bp, Bos taurus
gttaggagtccaaaatctcactgccaagggccgggtgttttggatacctggtctaggagctagtatcaccaaaacaaaacaaaaacaaaaaacactgcccyggccttttccatttttgttaaacggattatattacttttatcatagggaaaaaatacggcagtcttgtttatatttgatttgtgaactgtatgtatatct

SEQ ID NO: 119489 - DNA, 201 bp, Bos taurus
tcatctctataccctctcacttgctccccccgagcaatttgaagcaaatcttagaaaccacctcagtccccagggtcgcaaagagttggacacggccaaamaactcactctttcacactttagaagcaacacccttctgtccatcagttcagttcagtcgctcagtcgtgtccaactctttgtgaccccatggattgcagc

SEQ ID NO: 119490 - DNA, 201 bp, Bos taurus
agtaattatatggctgtcctgagagtaggcaagaggcctgcgtatgattaggacagaggaaaggggtcataagtgagctatgacccctttatcagctacakcagggaccaaaaagtacaattccagtagggcttttttcttttttggctgctcagcttgtgggatcttacttcccccaccaggatggaacctgaggccccc

SEQ ID NO: 119491 - DNA, 201 bp, Bos taurus
gccaacctggccgcttttcagggtctgcgcaggcgcgctgtgctcagcgttgcgacggcagagagctttacggcttgtgggcgggactttggattggcggyaggaaggtgggccgggggagcggagaggacgggacctgggagtggaagggactgacttccctgaacggtgtcgggggccggcccgagagggcgagttgtt

SEQ ID NO: 119492 - DNA, 201 bp, Bos taurus
ctgcccagccatagttctccagccacctccagagaaggtcccaccccagcctagagagcaacggcctcagaaaactcaggagcctgaggcctggcacatgytattacactcataccttccacacacacgatcccaagcatccatccaacagttattaagtgcctactgcaggccaagcacttttctagggcactggcacta

SEQ ID NO: 119493 - DNA, 201 bp, Bos taurus; identical to SEQ ID NO: 78440

SEQ ID NO: 119494 - DNA, 201 bp, Bos taurus
gctctgtgcatggtcatgctggagccacagcagtccccaagacagcccgacgcctgagggtctcaaccagtcaaaacggtggggcctcttacttgcttctycaatgcaggtttcaaccgcagtggaggtggtggctacaaccagaaccgctggggtaacaacaaccgggacaacaacaactccaacaaccgaggcagctac

SEQ ID NO: 119495 - DNA, 201 bp, Bos taurus
ggctctgcctgctcggggctcctgcacttgttgagcctcaaatccaagctcagggtcagaaatgaggtcaaagccataggctctggagtcagatgggcctrtgtgtgaattcagcctctgctgccttccagctgtgtgaccttgggtaagcgacctcccctctcttggccttggtttcctcacctgaaacatgagaccagg

SEQ ID NO: 119496 - DNA, 201 bp, Bos taurus
ggtgtccctccagggcaggaatcccaagaagatgagtgacaaggccttcccatagaggtactccaggtggtccatgcccactatcaccaggttctccaggkcaggcattattaattggccaggtgaggggatttcacatactaatttcaatagtgacctgggcatgactatagtctttcttttaaaataaatttcctcagg

SEQ ID NO: 119497 - DNA, 201 bp, Bos taurus
aaatacaatcagagaggaaaaaaaatcacaaggatatagtcggttagtcacctcacagcaaccttccacagaaagtttataccttgaaggaacaagtagasactatttcatattgagttatttcccagagcctctcccactgtaaaataatgtcgccttcatttgttcattcttctcttttctttccacaacagataaatt

SEQ ID NO: 119498 - DNA, 201 bp, Bos taurus; identical to SEQ ID NO: 78443

SEQ ID NO: 119499 - DNA, 201 bp, Bos taurus; identical to SEQ ID NO: 78444

SEQ ID NO: 119500 - DNA, 201 bp, Bos taurus
tgggggccaggaaggggactaaggagtgccaggggaacacggccacagagcgaggttccacatttgtccacactgtgggaaggagtcagctgagtggtgcrgcaggagagccgggccttgacacccccctcaacccaaagcaagctctcttccaccctggacaaggcgccgccccctcttctttacaccctcttccctcat

SEQ ID NO: 119501 - DNA, 201 bp, Bos taurus
gcaggtccttaggaagcctggagtgctcagggtgatgctcacgccgtgccaggcccttgtccgaactttatgaacttaacacaactccttgactcctcacrgccacccctttgaggatggcctggtgttagctcagatttctgtaatggacagagtgaggcactcagataccatgtccagggcacatggctggtaacaggc

SEQ ID NO: 119502 - DNA, 201 bp, Bos taurus
cgctccatttagagtggcgtgacagtcggtggggggacctagtttcttatgacagagattaaagttcagggtctagtttggaacattagaccaggagtccrgactgtgtactgggtgttagggggaagccagctgcctagcttggggcacagagactgggggtgtggttgtgcagttggtcagactgaggaccatcagttt

SEQ ID NO: 119503 - DNA, 201 bp, Bos taurus; identical to SEQ ID NO: 78448

SEQ ID NO: 119504 - DNA, 201 bp, Bos taurus
ggtaacttggggagaacatgtagagagaggcccttctgaggctccctttccttctgcccctgggtggttagttaatgtcctaccagcacttcccacttgtsgggggccaggaccatgttccagccccacatcactgctcagggcagagggcactttgtccagacagcttagattccagagagacctgcctctgagcttcac

SEQ ID NO: 119505 - DNA, 201 bp, Bos taurus; identical to SEQ ID NO: 78451

SEQ ID NO: 119506 - DNA, 201 bp, Bos taurus; identical to SEQ ID NO: 78452

SEQ ID NO: 119507 - DNA, 201 bp, Bos taurus
acttaggcagcacttgggctgaaagtttgaattcttgatctcatcttttttatttcaccattttgtgtgctgatgtcaggagcaacaaaccaaggtcatcrtattccttgagtgagtgagtgagtgagtgagtgaagtcgcttagtcgtgtccaactctttgcaaccccatggactgtagcctaccaggctcctccctcca

SEQ ID NO: 119508 - DNA, 201 bp, Bos taurus
tggggtgaggagcatggtgatagaatctgaaggtccctaaagcgctgtggttaggaggtgagtgaatgtcgatggaagactggtgtggtgaatggataagsctgggaggtggggtctggggagctggaatcctaggtccccaagtcccttggcccctgagaagggcagagacttaaggagaggttcagaatcatcgattac

SEQ ID NO: 119509 - DNA, 201 bp, Bos taurus
cttatgtctcctgcgttggaaggcgggttctttactattgagccacttgggaagtcccagcatgaagattagatggtagtaattcatcactgctaatatgkttttatttctgaggttatactttggttatgtaagagatgatcctgtgtgtaggaaatacattaaatatctataagtgttggagcataagtttggcaactc

SEQ ID NO: 119510 - DNA, 201 bp, Bos taurus
cagcccttgagcctcagagcaactggcaaaggctgcagggtgtctaggcaaatccaccctgcctgccaatttcctgcccaaggaatgggaaggagggccgygtgccacttccgtgagtcagaaatgctcccggctctttcctcctctgctggatggatgcagaaccgtgagatggaaggatcctggatcccaggatggcca

SEQ ID NO: 119511 - DNA, 201 bp, Bos taurus; identical to SEQ ID NO: 78453

SEQ ID NO: 119512 - DNA, 201 bp, Bos taurus; identical to SEQ ID NO: 78454

SEQ ID NO: 119513 - DNA, 201 bp, Bos taurus; identical to SEQ ID NO: 78455

SEQ ID NO: 119514 - DNA, 201 bp, Bos taurus
agagcccgtctccagtggtgttccaataactatgacgggaccacaagggcagggcctgggcctatgttggttacagttgaggccctagcagcggacggggracgctgtcagcgctcagggctgagtaactgccgcttattaagggttcgggcgtgccggaccccgcgcctgctacttcagtgcattgtttctggtcctttc

SEQ ID NO: 119515 - DNA, 201 bp, Bos taurus; identical to SEQ ID NO: 78459

SEQ ID NO: 119516 - DNA, 201 bp, Bos taurus
ggcccatataagtgtttaattgcttttctttggttggccaaaaagttcattcggggttttccgtaacatctcctggaaaaacccaaacaaactttttggcmaacccaataaaatccaagaagaactgaacttctaggttaagtgaagtgttttaatattcagtatttgtctttatatcaatgcagtcatgaaaaaatactt

SEQ ID NO: 119517 - DNA, 201 bp, Bos taurus; identical to SEQ ID NO: 78461

SEQ ID NO: 119518 - DNA, 201 bp, Bos taurus; identical to SEQ ID NO: 78465

SEQ ID NO: 119519 - DNA, 201 bp, Bos taurus; identical to SEQ ID NO: 78467

SEQ ID NO: 119520 - DNA, 201 bp, Bos taurus; identical to SEQ ID NO: 78474

SEQ ID NO: 119521 - DNA, 201 bp, Bos taurus
tacttaatatggggtcagggagctggccaggaaggatgggagtggagtgacaacggttgctatgggactcagttccgaaggcaaccttggtgctgggctcygcgtctgtggccttggtacaaagcctcacacttgtgatcttggtataggtcctcacagttctctcatgcttggcattcacgattgtaccttcaatctcac

SEQ ID NO: 119522 - DNA, 201 bp, Bos taurus; identical to SEQ ID NO: 78475

SEQ ID NO: 119523 - DNA, 201 bp, Bos taurus; identical to SEQ ID NO: 78477

SEQ ID NO: 119524 - DNA, 201 bp, Bos taurus; identical to SEQ ID NO: 78478

SEQ ID NO: 119525 - DNA, 201 bp, Bos taurus; identical to SEQ ID NO: 78479

SEQ ID NO: 119526 - DNA, 201 bp, Bos taurus; identical to SEQ ID NO: 78480

SEQ ID NO: 119527 - DNA, 201 bp, Bos taurus
agggtatgacaggagccatcggagaaagctcttggctctgacgggtttgcggggtgtcacagcttcctggggccaagagcaacagaagtgcattctctcgmgctcctgaaagagagaaacatgatcgaaatcagggcgtcggcagggctgcgtgctctcaaggctctgggggaagacccctccttgcctcctgcgggtggc

SEQ ID NO: 119528 - DNA, 201 bp, Bos taurus; identical to SEQ ID NO: 38451

SEQ ID NO: 119529 - DNA, 201 bp, Bos taurus; identical to SEQ ID NO: 38452

SEQ ID NO: 119530 - DNA, 201 bp, Bos taurus
agggctgaggggcccttctcccctctctgtcctcccagatataggacagtggccctgagatttcatcacaggcaagggcaagtaggggtgaaggccccccmaccctggaggtcaggggcgggggcaggagaggcaactcagtgaacccaggacagggggatggatgttagaagaagatgttatctcaacctgggagataat

SEQ ID NO: 119531 - DNA, 201 bp, Bos taurus; identical to SEQ ID NO: 38453

SEQ ID NO: 119532 - DNA, 201 bp, Bos taurus; identical to SEQ ID NO: 38454

SEQ ID NO: 119533 - DNA, 201 bp, Bos taurus; identical to SEQ ID NO: 38455

SEQ ID NO: 119534 - DNA, 201 bp, Bos taurus; identical to SEQ ID NO: 38456

SEQ ID NO: 119535 - DNA, 201 bp, Bos taurus; identical to SEQ ID NO: 78493

SEQ ID NO: 119536 - DNA, 201 bp, Bos taurus
caaagagtcggacatgcctaagcgacttcactttcactttcaagcatgcgtttagaagttctttactaaaaggtgaacgagggccgtacacagttacagcktttttcatctgttgcatgtgagaaaaatcaatgcattcgtattctggtattagttgcccttcagcataaacatttcctaacacaagaaaggcaagaacat

SEQ ID NO: 119537 - DNA, 201 bp, Bos taurus; identical to SEQ ID NO: 38460

SEQ ID NO: 119538 - DNA, 201 bp, Bos taurus; identical to SEQ ID NO: 78501

SEQ ID NO: 119539 - DNA, 201 bp, Bos taurus; identical to SEQ ID NO: 78503

SEQ ID NO: 119540 - DNA, 201 bp, Bos taurus; identical to SEQ ID NO: 38461

SEQ ID NO: 119541 - DNA, 201 bp, Bos taurus; identical to SEQ ID NO: 38462

SEQ ID NO: 119542 - DNA, 201 bp, Bos taurus; identical to SEQ ID NO: 78506

SEQ ID NO: 119543 - DNA, 201 bp, Bos taurus; identical to SEQ ID NO: 78507

SEQ ID NO: 119544 - DNA, 201 bp, Bos taurus; identical to SEQ ID NO: 38463

SEQ ID NO: 119545 - DNA, 201 bp, Bos taurus; identical to SEQ ID NO: 78514

SEQ ID NO: 119546 - DNA, 201 bp, Bos taurus; identical to SEQ ID NO: 38471

SEQ ID NO: 119547 - DNA, 201 bp, Bos taurus; identical to SEQ ID NO: 38472

SEQ ID NO: 119548 - DNA, 201 bp, Bos taurus; identical to SEQ ID NO: 78517

SEQ ID NO: 119549 - DNA, 201 bp, Bos taurus; identical to SEQ ID NO: 38474

SEQ ID NO: 119550 - DNA, 201 bp, Bos taurus
ctcatcaaccttacaagcgtttgcacagcaagggaatttagaaagaaaaagacagccctcagaatggggaaaatatttgcaaatgaagaggcccataagcrattcatctccagaacatacaaacagcttgtacagctcaatatttttttaaaaatgcagtagaaaaatgggccagagctctaaatggatacttcatcagag

SEQ ID NO: 119551 - DNA, 201 bp, Bos taurus; identical to SEQ ID NO: 38475

SEQ ID NO: 119552 - DNA, 201 bp, Bos taurus; identical to SEQ ID NO: 78523

SEQ ID NO: 119553 - DNA, 201 bp, Bos taurus; identical to SEQ ID NO: 78525

SEQ ID NO: 119554 - DNA, 201 bp, Bos taurus; identical to SEQ ID NO: 38488

SEQ ID NO: 119555 - DNA, 201 bp, Bos taurus; identical to SEQ ID NO: 78533

SEQ ID NO: 119556 - DNA, 201 bp, Bos taurus; identical to SEQ ID NO: 38491

SEQ ID NO: 119557 - DNA, 201 bp, Bos taurus; identical to SEQ ID NO: 38492

SEQ ID NO: 119558 - DNA, 201 bp, Bos taurus; identical to SEQ ID NO: 38493

SEQ ID NO: 119559 - DNA, 201 bp, Bos taurus; identical to SEQ ID NO: 78534

SEQ ID NO: 119560 - DNA, 201 bp, Bos taurus
atcagccactgcagccaccctagccagtgtaccctgaggggaatttgggatgcagaaaaacaggatactgactctcagtagtgaagatgcatatccaggarctatttcaatgagcccagacccttgtatattcctgtacatagagaagcactgaattcactaacttgagatgtctgcttttcacgattaccagtaatcttc

SEQ ID NO: 119561 - DNA, 201 bp, Bos taurus; identical to SEQ ID NO: 78536

SEQ ID NO: 119562 - DNA, 201 bp, Bos taurus; identical to SEQ ID NO: 78537

SEQ ID NO: 119563 - DNA, 201 bp, Bos taurus; identical to SEQ ID NO: 78539

SEQ ID NO: 119564 - DNA, 201 bp, Bos taurus; identical to SEQ ID NO: 78541

SEQ ID NO: 119565 - DNA, 201 bp, Bos taurus
gccacacaggtcatggacacaaatcctgtctcagccaaaacctcctctggcaatgtaagtccaagcaggctaaatgcaaacccacttcaaagcttcctctrgctatgctggcctctgagggtgtacctgagcctgtaccccagttggcctctgcagacacatgtgctctagaccagctccagaaacatatattgttgagag

SEQ ID NO: 119566 - DNA, 201 bp, Bos taurus
cttaatcttatacttctatgttcatgttcagtcttaaaactcccctaaattatttgttctaaactcagcaatctttcccctgttcttgtattgctgatcckgttagtgatgtcaattgtcttgttgttcacactgcttgctgaacccagggtaggcaagacatgagctaagaggctggaagaagactccaggaactgtagg

SEQ ID NO: 119567 - DNA, 201 bp, Bos taurus
cttcccctttggtaactataagtttgttttctatgtctttgagtctatttttttttttttcaaaattagttcatttgaatcattttttaaagattcaatayataagtgatatcatatgacttagtatgataatctttagacccatccttgttgctgcaaatgcattatttcacaatttttaatggctgagtaatataccat

SEQ ID NO: 119568 - DNA, 201 bp, Bos taurus; identical to SEQ ID NO: 78542

SEQ ID NO: 119569 - DNA, 201 bp, Bos taurus; identical to SEQ ID NO: 78543

SEQ ID NO: 119570 - DNA, 201 bp, Bos taurus
atagacggcagcccaccaggcccccccgtccctgggattctccaggcaagaacactggagtgggtagaaaaaagctattacaggtggcctttgcatcaggytcttgaatgtagtcagctttggttaagataagaggtttagagtataataaacatggtgacctacaggcaaagaaggaagaaagcaatatggtggccacaa

SEQ ID NO: 119571 - DNA, 201 bp, Bos taurus
gataaaaagccctcaaaagtgctgattagtatgtcattctattaggaagattgagcttgctaagaaaatattgtgtgattgcatttttattgttgtcgggktttttttgtgtgtgtgtgtgatatggatatagttaacagtctcctgattcgttatgtattataagtttaaattttattatatcaagggttcttgaaacct

SEQ ID NO: 119572 - DNA, 201 bp, Bos taurus; identical to SEQ ID NO: 78546

SEQ ID NO: 119573 - DNA, 201 bp, Bos taurus; identical to SEQ ID NO: 78547

SEQ ID NO: 119574 - DNA, 201 bp, Bos taurus
aaggaaaacgagtagcttgtgtccaaaacactcaaactctgaaggatttcagagagagtttttaaaggcaaatttgtagggagtgctacagagtgtgtcamtctcttctagtttgtcggtgccggggtaacagggtggtgctccaggaatctcagtcatctgcctctggttccaaccagtctcagggactacacgctcaag

SEQ ID NO: 119575 - DNA, 201 bp, Bos taurus
aacttttcatgttgtctcctctgacactcttgtggatgagatcttattccaaccagacagtggtaaagccctgagtctccacttggcctcctccagtgtcrctccagaaggaaggtaaaggggcactttgctactggtgaggtgcacgttcaggctccttacctggccttcactgatactataatcagggcatgaggaatg

SEQ ID NO: 119576 - DNA, 201 bp, Bos taurus; identical to SEQ ID NO: 78549

SEQ ID NO: 119577 - DNA, 201 bp, Bos taurus; identical to SEQ ID NO: 78550

SEQ ID NO: 119578 - DNA, 201 bp, Bos taurus
ggaattctgaggtgctggcagctgtctagggtccagccaacttctgctgcctgatgtaatttgaattaagttctttgttgatagaaacaattctgtgcacygtgtttcttgatatgggtgtagacatttatttgatatgttcccgttttcccccaactttggctgtgtgacccctgcagttgctggatgagttgccagttt

SEQ ID NO: 119579 - DNA, 201 bp, Bos taurus; identical to SEQ ID NO: 78553

SEQ ID NO: 119580 - DNA, 201 bp, Bos taurus; identical to SEQ ID NO: 78554

SEQ ID NO: 119581 - DNA, 201 bp, Bos taurus; identical to SEQ ID NO: 78555

SEQ ID NO: 119582 - DNA, 201 bp, Bos taurus
tcattaattactttcttagatgcccccactgctatacacaaccacactgggggttggggcttcaacatacgaattttgcaggaacacacacgctcagtccrtaacaacagcaaaactgttaagcaggcagtagttaataattgagaattaatatactgtttacatttgaaagagaagtctgagtacattttttgctctgca

SEQ ID NO: 119583 - DNA, 201 bp, Bos taurus; identical to SEQ ID NO: 78556

SEQ ID NO: 119584 - DNA, 201 bp, Bos taurus
ctggaggtgtgggaccctcccccacgtgctgctgctgttcagtctgctgtgtctcagtttagtagaatgttggggaaaagaacctccctcctactagggtraggtcgcagaggcctctggagaaaacagagcagaaaattatttaaacaactgcggcatttgaaaaatcattttgagaaaggtttaaaatattttttaaaa

SEQ ID NO: 119585 - DNA, 201 bp, Bos taurus; identical to SEQ ID NO: 78557

SEQ ID NO: 119586 - DNA, 201 bp, Bos taurus
agagagactggcctatcaattgcctgatgcactgaattacagaataggacccagccaaggtgcccttttagtgcctgatgcacagatctacagagtaagaygccagccaggggggcccctctatgtgcctgatatgtggaacaacagaaaaggaccccaggcaagggaactctctaagtgcctgaatgggtggggctatgg

SEQ ID NO: 119587 - DNA, 201 bp, Bos taurus
agttggtcttccacagtagttaaactaaaatcttggcccctttactctgagtctcaaagccctttggacccagggctgctacctctctggcctcagctgckacagctctccctcatcacagtgctctggaacccctggctttctgttccctgagtaagccagcctgtcaacctaaggaccctctcccaagccaggaatggg

SEQ ID NO: 119588 - DNA, 201 bp, Bos taurus
tcatttcctggaccacaacatactagtcaggcagatggtccagggacttttggctctgatagggcttagtccagtaacagcacaccaagtggcccatcaaygaaatcttagcctgacctaggagcaagtgatcctagcactctggcacaaaatagtcatgaaatgcctcccagtccatggtccaatttatggccatgatgg

SEQ ID NO: 119589 - DNA, 201 bp, Bos taurus; identical to SEQ ID NO: 78558

SEQ ID NO: 119590 - DNA, 201 bp, Bos taurus
cagtctaaatctagctccactgactggaggcaatttgttggtacagccttttccaaaatgaagatggagacaggtacagccgcaggaacattgggcatgayctgatatctagtacctctggagttatcccttgtttcccaccttgatgcatatgtttcaagctaactccttctccatccccagctctcctaacgatactgt

SEQ ID NO: 119591 - DNA, 201 bp, Bos taurus; identical to SEQ ID NO: 78559

SEQ ID NO: 119592 - DNA, 201 bp, Bos taurus
tggatctgtagacagtcctatgaaatagacagaaaagggattagttcccacatcatgtaatgaccacagcaggaatggggagcccactgtaaaggaggccrgtaagttcatatttctcatttctcagaggcagagctccccttcctggtctgcagtgtcagagagaaaagttggcgtcagttcttggccgactgcttccca

SEQ ID NO: 119593 - DNA, 201 bp, Bos taurus; identical to SEQ ID NO: 78563

SEQ ID NO: 119594 - DNA, 201 bp, Bos taurus
atcactcagcagctgggttcctgctgccccagctgtcaagtttccagctcatgcattcagttatccatcaatggagatctcaggggcagttgagcgggagyggacaaaccagcctttctttatgccaacagggaatgcttgaaataaccagacacacaactctgattgatgcggccacagtttacacaccacactacggac

SEQ ID NO: 119595 - DNA, 201 bp, Bos taurus; identical to SEQ ID NO: 78564

SEQ ID NO: 119596 - DNA, 201 bp, Bos taurus
aaaggatggcctggaaggaagggacagctgggatggtatgagaaggaactcaaagaaagggaagaagccagtctcttctgagtgaagggaacagatgggaratgagcaaagacaaaagaggccacgtgggtaggtgtcatcagttagaggccaagccactagaatttgatcaatcgacaagaatgtatttactggactcct

SEQ ID NO: 119597 - DNA, 201 bp, Bos taurus; identical to SEQ ID NO: 78565

SEQ ID NO: 119598 - DNA, 201 bp, Bos taurus; identical to SEQ ID NO: 78566

SEQ ID NO: 119599 - DNA, 201 bp, Bos taurus; identical to SEQ ID NO: 78567

SEQ ID NO: 119600 - DNA, 201 bp, Bos taurus
cagaggagacttctgtgtcttttagtgaacagtggcctctgctctgctctgcatctctgagagtcctaatgcccaggtcacatcacccagaggaggtgcgraaggcaaacagcagcgcctcgggccctgcagggagagtggagcccccaccgcagggccaccaaacactctgcatcagacaaggaggacgggcggcagtac

SEQ ID NO: 119601 - DNA, 201 bp, Bos taurus; identical to SEQ ID NO: 78569

SEQ ID NO: 119602 - DNA, 201 bp, Bos taurus
cattgtccctgatcgtcatttagccagaatacaagtctcatcatttcgcttctctgtggtttttgcattgcctttggaatcaagttcacgttccttaacayggttcacaaagttcttaggttgtaatcagataatcctgtgtcctcttctacaaacaccctgcacttctactctttttcttccctaggatgttcttgtcct

SEQ ID NO: 119603 - DNA, 201 bp, Bos taurus
gtcgatctgctcccccagctcggccacactgtccgcgtgcttcttcctcagtgtggtcgtcgtggcctcgtgctgcagagtggcctcctccaggtcccggmgcagtttctggaactcagcctcccgcttcttgttcatctcgatctggactgaagtggccccgctggcttcttccagccgctcgctgatctcctccagttc

SEQ ID NO: 119604 - DNA, 201 bp, Bos taurus; identical to SEQ ID NO: 78723

SEQ ID NO: 119605 - DNA, 201 bp, Bos taurus; identical to SEQ ID NO: 78724

SEQ ID NO: 119606 - DNA, 201 bp, Bos taurus
gttttgcagtaaaaatgggtggcctttttcatcggctgacatccagtctcttttttcttttaatcaggatgtgagatcattttgtcaggcaaagagggaartggaaatttgaggagagtgggaagatttgaagtagagagaagtaagagtgagcaagctgactacgtaactcctgcactgaaggctcactggggttagtga

SEQ ID NO: 119607 - DNA, 201 bp, Bos taurus
gacacccgctcgccaggcacacagcgcaggcaggggagggtgagggtgggggcgggggcggtgaccccacagcctctgcacagatcagagtggaagggggkggtcatcgggccacactgacaaaccgaggtccgtggagcatccagagggatcctgcccaagggggccctcgaagacaaagtcaaggggagcttggggagg

SEQ ID NO: 119608 - DNA, 201 bp, Bos taurus
tttagctgaaacacaaaaccaaggaccttaatatccttgaattattttgtagctactaaaacacacaccaggtagaagaagttaactgcatgctgaccacyggcatgttgaccccaggatggttggaaccaggttggtcatgttgactcctgaaatacaccgtggtgacctcaccaccagtcagttaggagaatgtccaga

SEQ ID NO: 119609 - DNA, 201 bp, Bos taurus
cgtgtacatttttgaggccctgtgtacttgcttgctctctcctagattaacagtttctccaggacttggagaaaatttagctcttcctgcagctccagagygcgcaccacgcaggtaggcaggcctttccagccggctgtgctccgagccaacctggcagcctcacaggcccctccgaggcagagaggagagcctgtgagc

SEQ ID NO: 119610 - DNA, 201 bp, Bos taurus
gaaggccgcccaagcaggagctgagttttctctcacaatctgaggaccttggggtcaggaagtaatttctctgccttcctaattcaccatggccacctccrgaccatgtgctcctctcccttctgcaaaaatcctttcttatttcaagctcaggctgcgcagatgtcttactctttctcccttctcatccctgccatctgc

SEQ ID NO: 119611 - DNA, 201 bp, Bos taurus
tggggagtacaataggaaataaatttagaaactggagtaggaattctctggggaaacgaagactggtgaaggtgggaacggagacagagaaaatgtatgarccagaaggccagaccctagatcttatgaaagatgcaccttaaatccttctctgggatcatggagaatataaataattgatgcctagctttttcctaaatg

SEQ ID NO: 119612 - DNA, 201 bp, Bos taurus
tggagcggctcctggcgcggcggcggcctgtcatgctggtgggaactgcgggcactggcaagtcggtgctggtgggggcgaagctggccagcctggacccygaggcgtacctggtgaaaaacgtgcccttcaactactacaccacatcagccatgctgcagggtgagtgtcaacacctcaataaccaagtgaatcggcctg

SEQ ID NO: 119613 - DNA, 201 bp, Bos taurus
tggatgatgccgacgtggccacctggcagaatgagggcctccctgcagaccgcatgtccacggagaatgccgccatcctcctcagctgcgagcgctggccrctcatggtggaccctcagctacaaggcatcaaatggatcaagaacaagtatggtgaggacctccgggtcacccagatcggccagaaggggtaggtgtctg

SEQ ID NO: 119614 - DNA, 201 bp, Bos taurus; identical to SEQ ID NO: 78730

SEQ ID NO: 119615 - DNA, 201 bp, Bos taurus; identical to SEQ ID NO: 78731

SEQ ID NO: 119616 - DNA, 201 bp, Bos taurus; identical to SEQ ID NO: 78732

SEQ ID NO: 119617 - DNA, 201 bp, Bos taurus; identical to SEQ ID NO: 78733

SEQ ID NO: 119618 - DNA, 201 bp, Bos taurus; identical to SEQ ID NO: 78734

SEQ ID NO: 119619 - DNA, 201 bp, Bos taurus; identical to SEQ ID NO: 78735

SEQ ID NO: 119620 - DNA, 201 bp, Bos taurus; identical to SEQ ID NO: 78736

SEQ ID NO: 119621 - DNA, 201 bp, Bos taurus; identical to SEQ ID NO: 78737

SEQ ID NO: 119622 - DNA, 201 bp, Bos taurus; identical to SEQ ID NO: 78738

SEQ ID NO: 119623 - DNA, 201 bp, Bos taurus
tccttttccacctagaaagaaatcaaggtgccatggtcacctgaacaggaaagagctccccccatgtccacgctgggcccactgatacaacagcaaaggaraccttgggcacgtgtgtgcccagcaccatctctatgttctgggcttcaaaaacagccaaggcagagaagtgtgatggatgtcagtggccgaatggatgga

SEQ ID NO: 119624 - DNA, 201 bp, Bos taurus; identical to SEQ ID NO: 78739

SEQ ID NO: 119625 - DNA, 201 bp, Bos taurus
ggagagataaaattagcctacttactagatattctaaccaaaatctttctgacgattgacaaacccgaattaactttttggccaagccagtagaatgctgktttttttttttgtttgtttgttttttatttatttatttttttttaattattaatttctgaaccctcctccctctgccctccccataccatccccctgggc

SEQ ID NO: 119626 - DNA, 201 bp, Bos taurus
taggtggcccctactgtccgtctccttccttccttcctgccctccatacactggtgtccaagctggaggcctcgccacccactgcaggtcatgtctggttmacagaagtgttgaggagtctctgagttatttcagtgctcaatttcactgtgtgagccaagaccggaggttctgcagccttgattttaaagatacttgatt

SEQ ID NO: 119627 - DNA, 201 bp, Bos taurus; identical to SEQ ID NO: 78741

SEQ ID NO: 119628 - DNA, 201 bp, Bos taurus
ctcagcccgtctcactgggagtggccgtgttcccatcaaagccaacgctgagttctccccttttcccaggagatgagcgtggaactaatgggccacagcayaggatccacaagtacttggtcaggtcccggctcttcctctaccacctgtgacccggcacaagccccggtcaagccatctgtgaaacgggcaaggcactgg

SEQ ID NO: 119629 - DNA, 201 bp, Bos taurus; identical to SEQ ID NO: 78745

SEQ ID NO: 119630 - DNA, 201 bp, Bos taurus; identical to SEQ ID NO: 78746

SEQ ID NO: 119631 - DNA, 201 bp, Bos taurus
gggctgttgctcaggtagggagggtcagggctggggggcaggtgagtgaggctctcaacctgctcgcctctctggacggggcctgctctctgctctgttcrgtagcagtagagtgctgtgcttcacaggacccaggggtttcatcagggcagtggctcccaagcctggtgtctgggccaccttcctcaggtctgtggtcag

SEQ ID NO: 119632 - DNA, 201 bp, Bos taurus
gggcaggccttccctttacagaggaacttgctgctctcgagagactgagagttcgcttccctcctgggtttccgtcccgtcttctatcagggtaccgaaaygcgtggtttcaaggcctcccctcgggctgtggagggtagagcctggcgacagtgtggacgtgtgaagacagaagggcagccccgcgccgccagaggacgg

SEQ ID NO: 119633 - DNA, 201 bp, Bos taurus; identical to SEQ ID NO: 78747

SEQ ID NO: 119634 - DNA, 201 bp, Bos taurus
ggactgggattactctggaattgcttttggggaagtggactaggattttttttcactgggatgccctttgaggccagaccggcaggtcctgtgtgtgtccrtcccccagtaacatcactgatctctgtctcccagagtcactcagttgccgccaagagcaaggcaggtattatgacctgctcctgagggactgcgtcagct

SEQ ID NO: 119635 - DNA, 201 bp, Bos taurus
actggatgggccagggatcgggagacttctgaaaagggccagacggtgaataactccagcaccgaagtcaggcaggctccaggcagccggggtgcaccagrgaaatgagaggatgcaatcaaaggcctagggccatcacctgaagacacctgggtccttgcaggaccctgtcctgcattcgggccctgagcctggagggtc

SEQ ID NO: 119636 - DNA, 201 bp, Bos taurus; identical to SEQ ID NO: 78749

SEQ ID NO: 119637 - DNA, 201 bp, Bos taurus
cccagacatcgtgtaatttcatccacaagagtttcaaaatgtatttctgaaggttatgacttaaaagacaattacagcgtcattgtttagatcttcatgcrtcacagccattccttaatatcagcaaatatccagtctcagtctacagttgtctcctcaatgtcagaatgaacaaaatatggtttgaatcagcatctgaat

SEQ ID NO: 119638 - DNA, 201 bp, Bos taurus; identical to SEQ ID NO: 78750

SEQ ID NO: 119639 - DNA, 201 bp, Bos taurus
tttcacaatccaaagactgacagggcccaaggctagaagtggctctgcccagagacggcatatatacaactaacactgagcctcaggcggtcactgaaacrgcaggccgcttgatagaatttctcataaacactgctgcatcttcttgctcttaacccaaaggactgaaaaccttatcaactgaaagaaatatgtaatggg

SEQ ID NO: 119640 - DNA, 201 bp, Bos taurus; identical to SEQ ID NO: 78754

SEQ ID NO: 119641 - DNA, 201 bp, Bos taurus; identical to SEQ ID NO: 78755

SEQ ID NO: 119642 - DNA, 201 bp, Bos taurus
aagcaaaaagggcattatgatgacacttttgatacacttactggaatttttttcttcagttcagtctcttgtacgttctatttccaaattcactccagacwctaactcagctatcaaaactagctcagtaataatctccctcaagtttcaaaatatatcagataatcaaatcagctttattttcttccatgagctttccat

SEQ ID NO: 119643 - DNA, 201 bp, Bos taurus
ggggttagtcctcttccagccatccagatcaattagagattctcagaagcagtggaggtccctggctgggcggtggcctacagaggagtagctccagggcrtttcctgggcttagaaacggaggctgaggaagtcacagtgagcgatgggccctgcactgcatctttcttatagagtcctctgtggtcagctgactctgag

SEQ ID NO: 119644 - DNA, 201 bp, Bos taurus
ctgggagacaagagctctacagaccacagatgcctctgtgggatccatgctgccctgcgaacaggggagaagcacaactttcttatttgcaggctgctgcrttatatgtttacctggccccagagagggcaagttggtccaggcactgagataccagagcacatcatggtgccctggggcgactgaaagctggagcctcag

SEQ ID NO: 119645 - DNA, 201 bp, Bos taurus; identical to SEQ ID NO: 78756

SEQ ID NO: 119646 - DNA, 201 bp, Bos taurus; identical to SEQ ID NO: 78759

SEQ ID NO: 119647 - DNA, 201 bp, Bos taurus
ccattggaattttaagtgctggattaccactccctttctttagagaggattagtgagggttggctcatccactatctagaggcatttatgattgaaaaacrgaagctctgccagattaacctggaatttgattgccctaaataactacagttggagaaacctgaattgggcaaatggagggccttgagtggatgaccaggg

SEQ ID NO: 119648 - DNA, 201 bp, Bos taurus; identical to SEQ ID NO: 78760

SEQ ID NO: 119649 - DNA, 201 bp, Bos taurus
aaagggtcccagttctggagggtcctagaccccttctccagttcagagagtctacctcaggctcaaacatgcactatctgtgctctggccacagaggccamctctctgccacccacccagtcccaagccggcagccacagattaccaaagcgtgggaaccgagtgcggcctgggaggatgctttccaaacacttagcccag

SEQ ID NO: 119650 - DNA, 201 bp, Bos taurus
ctaagagtggcttgcaatccaagtttactggatgtcctataatgtggagccttcaggactagaaaagctgaaatctcccacccaagagaaagcaccagcakagacagaagacttagcaggagaccaactggagcaaaagcctagcctattacactgcaatgctttaaacattttctacccacgaagaagaaaaacctgggg

SEQ ID NO: 119651 - DNA, 201 bp, Bos taurus
tccatcatcatcagctgtgagtgaaattgcagcttgtcctctgaatcctattgctgatgatctttcagctctagcatgtcccccatcctctccttcctccrgtaggtaactcttcttgcctggttactcaatgctagcccctgtatgccagctattgtactgaaccactgtacttttcaaggtactgtactataagattaa

SEQ ID NO: 119652 - DNA, 201 bp, Bos taurus; identical to SEQ ID NO: 78766

SEQ ID NO: 119653 - DNA, 201 bp, Bos taurus
tttccagttggtgcaagttttcaattgcaaagtctgccagcaggggtcagcaaggcccctttactaagcacagagaagcctgcttttcttcactataaccrgtggtagtagtactccataaaacatattaatgaaagcagttgtcctgagactcttaagaactataattaacccaaagttctcttctctgtccaaaaggaa

SEQ ID NO: 119654 - DNA, 201 bp, Bos taurus
agaaataccttttgcaatcaaattgtgttctttattttgatctgaatggtgttaaaaattcagtttgtgcttaagacttgttctttcctgtaggtaagtcrtacttcatgacaaaagaaaaattaatcaaatggctgccatactgtaccctgtcatcaacatttgtatggtcctcatctgtttcctaatctcttcctcatc

SEQ ID NO: 119655 - DNA, 201 bp, Bos taurus
tgccaccagaggcaaagaggaaaaagtccccaacctggtacctcacaggatcaagaaccccatgcaaatgggtacacagcctcaaccccaggcccagagaygggcactgtcagtagggaaacaagaatctctcttttattaaagtccaactacattaacaaggaggagcagaagctgtgacttgaggctgaggggccacag

SEQ ID NO: 119656 - DNA, 201 bp, Bos taurus; identical to SEQ ID NO: 78768

SEQ ID NO: 119657 - DNA, 201 bp, Bos taurus; identical to SEQ ID NO: 78769

SEQ ID NO: 119658 - DNA, 201 bp, Bos taurus; identical to SEQ ID NO: 78770

SEQ ID NO: 119659 - DNA, 201 bp, Bos taurus; identical to SEQ ID NO: 78771

SEQ ID NO: 119660 - DNA, 201 bp, Bos taurus; identical to SEQ ID NO: 78772

SEQ ID NO: 119661 - DNA, 201 bp, Bos taurus; identical to SEQ ID NO: 78775

SEQ ID NO: 119662 - DNA, 201 bp, Bos taurus; identical to SEQ ID NO: 78779

SEQ ID NO: 119663 - DNA, 201 bp, Bos taurus
agatcccctggagaaggcataggctacccacttcagtattctggcctggaaaattccgtggtctgtacagtccatggggtcacaaagagtcggacacgacygagcgactttcgctttcactgggcctggactgtgctagactcagagacccagagcttccgagtccacagaggtgggagagagacagaccagagaacagtg

SEQ ID NO: 119664 - DNA, 201 bp, Bos taurus; identical to SEQ ID NO: 78782

SEQ ID NO: 119665 - DNA, 201 bp, Bos taurus; identical to SEQ ID NO: 78783

SEQ ID NO: 119666 - DNA, 201 bp, Bos taurus; identical to SEQ ID NO: 78784

SEQ ID NO: 119667 - DNA, 201 bp, Bos taurus
agccattaaactgaaattaaacccttgttggaatcacttaattcagggcatgacaaattgctttcagtggaggcagcagtgaagtcccctcagggagagayggagattagcagcttccatggctggctgggtcccctcattgtcttggcccccttgctggctctgaattctgaaattggggtcggaaccatctaaagacca

SEQ ID NO: 119668 - DNA, 201 bp, Bos taurus
atgataacaaaaggcagtatagataagtgtatatgtgccatgttcactttaatgactattcataagccagtaactaactatggagactatttctggatcartacaatccaagtgtggttgtaggtacactcaacacattaacacaactcttggtatctgacactgatgaaaaataaaaaagggtaggtgaacaaacacata

SEQ ID NO: 119669 - DNA, 201 bp, Bos taurus
gtcctcttggattttccttcatacaaggtagacagtagattctacttagagaactcacagacatctataacccagatggtgatatgagcggcaggacccargctcccatgtctcttgccattactaactcaatttgctggggagtctcgtctctgtctcttggaggttgacccctcagtttcttctgactttttttttttt

SEQ ID NO: 119670 - DNA, 201 bp, Bos taurus; identical to SEQ ID NO: 78786

SEQ ID NO: 119671 - DNA, 201 bp, Bos taurus
aacattttattggagagcagcaagaaagctttacagactcctagaatatcacaaataagcaagcaggagaggaaatgacagaatagagatacttcgtgcaygcttagaggacaattttagaatacaaaagccttcttaacttgaatttcaagtttggatgtccctgattgaagcaccgtcttctttcaaggattctgctgg

SEQ ID NO: 119672 - DNA, 201 bp, Bos taurus
tagctcctctaggccctcctgcacctgcgcagccactgctccttggacgtggggtagctcctcccagtcgctgcccctggcctcgggccggggttgcgggsgtcgtgtatctcctcccagatgccacccctgacctcagacatggggtagctcctctcagctgccacccctgaccttggacatggggtagctcctctcggc

SEQ ID NO: 119673 - DNA, 201 bp, Bos taurus; identical to SEQ ID NO: 78787

SEQ ID NO: 119674 - DNA, 201 bp, Bos taurus; identical to SEQ ID NO: 78788

SEQ ID NO: 119675 - DNA, 201 bp, Bos taurus; identical to SEQ ID NO: 78790

SEQ ID NO: 119676 - DNA, 201 bp, Bos taurus; identical to SEQ ID NO: 78791

SEQ ID NO: 119677 - DNA, 201 bp, Bos taurus; identical to SEQ ID NO: 78792

SEQ ID NO: 119678 - DNA, 201 bp, Bos taurus; identical to SEQ ID NO: 78793

SEQ ID NO: 119679 - DNA, 201 bp, Bos taurus; identical to SEQ ID NO: 78794

SEQ ID NO: 119680 - DNA, 201 bp, Bos taurus; identical to SEQ ID NO: 78795

SEQ ID NO: 119681 - DNA, 201 bp, Bos taurus; identical to SEQ ID NO: 78796

SEQ ID NO: 119682 - DNA, 201 bp, Bos taurus; identical to SEQ ID NO: 78797

SEQ ID NO: 119683 - DNA, 201 bp, Bos taurus; identical to SEQ ID NO: 78798

SEQ ID NO: 119684 - DNA, 201 bp, Bos taurus; identical to SEQ ID NO: 78799

SEQ ID NO: 119685 - DNA, 201 bp, Bos taurus; identical to SEQ ID NO: 78800

SEQ ID NO: 119686 - DNA, 201 bp, Bos taurus; identical to SEQ ID NO: 78801

SEQ ID NO: 119687 - DNA, 201 bp, Bos taurus; identical to SEQ ID NO: 78802

SEQ ID NO: 119688 - DNA, 201 bp, Bos taurus; identical to SEQ ID NO: 78803

SEQ ID NO: 119689 - DNA, 201 bp, Bos taurus; identical to SEQ ID NO: 78804

SEQ ID NO: 119690 - DNA, 201 bp, Bos taurus; identical to SEQ ID NO: 78805

SEQ ID NO: 119691 - DNA, 201 bp, Bos taurus; identical to SEQ ID NO: 78806

SEQ ID NO: 119692 - DNA, 201 bp, Bos taurus; identical to SEQ ID NO: 78807

SEQ ID NO: 119693 - DNA, 201 bp, Bos taurus; identical to SEQ ID NO: 78808

SEQ ID NO: 119694 - DNA, 201 bp, Bos taurus; identical to SEQ ID NO: 78810

SEQ ID NO: 119695 - DNA, 201 bp, Bos taurus; identical to SEQ ID NO: 38618

SEQ ID NO: 119696 - DNA, 201 bp, Bos taurus; identical to SEQ ID NO: 78813

SEQ ID NO: 119697 - DNA, 201 bp, Bos taurus; identical to SEQ ID NO: 78814

SEQ ID NO: 119698 - DNA, 201 bp, Bos taurus; identical to SEQ ID NO: 38619

SEQ ID NO: 119699 - DNA, 201 bp, Bos taurus; identical to SEQ ID NO: 78815

SEQ ID NO: 119700 - DNA, 201 bp, Bos taurus; identical to SEQ ID NO: 78816

SEQ ID NO: 119701 - DNA, 201 bp, Bos taurus; identical to SEQ ID NO: 78817

SEQ ID NO: 119702 - DNA, 201 bp, Bos taurus; identical to SEQ ID NO: 38625

SEQ ID NO: 119703 - DNA, 201 bp, Bos taurus; identical to SEQ ID NO: 78824

SEQ ID NO: 119704 - DNA, 201 bp, Bos taurus; identical to SEQ ID NO: 38629

SEQ ID NO: 119705 - DNA, 201 bp, Bos taurus; identical to SEQ ID NO: 38630

SEQ ID NO: 119706 - DNA, 201 bp, Bos taurus; identical to SEQ ID NO: 38631

SEQ ID NO: 119707 - DNA, 201 bp, Bos taurus; identical to SEQ ID NO: 38632

SEQ ID NO: 119708 - DNA, 201 bp, Bos taurus; identical to SEQ ID NO: 38633

SEQ ID NO: 119709 - DNA, 201 bp, Bos taurus; identical to SEQ ID NO: 38635

SEQ ID NO: 119710 - DNA, 201 bp, Bos taurus; identical to SEQ ID NO: 78835

SEQ ID NO: 119711 - DNA, 201 bp, Bos taurus
cttcctcggaggcagagtggaaggcgtggtttgggaagggggctcaggtgttcactgaggaaatagcgtgagtcagctcatgtcccagaaaggccatgtcygcctgcccgcggtctggctaaaagtgtgtctctcagcgtgggctgggctgtgctagcctgaccctccacccccagcagctgttcatgacacagcagtgtg

SEQ ID NO: 119712 - DNA, 201 bp, Bos taurus
acgggcgagagtcaggcaccaggcgccgccgggctggccgctgcccacctggtaccctaccaatgaacaccccaaagacggcctgaggaacccacctctcyaattagggggcagccaaaaatctagtttctcgtccaaactatgcacccgagcaaacctgctctccagaaaccgtccccatgacagaaggcagcaggccac

SEQ ID NO: 119713 - DNA, 201 bp, Bos taurus; identical to SEQ ID NO: 38645

SEQ ID NO: 119714 - DNA, 201 bp, Bos taurus; identical to SEQ ID NO: 38646

SEQ ID NO: 119715 - DNA, 201 bp, Bos taurus; identical to SEQ ID NO: 78837

SEQ ID NO: 119716 - DNA, 201 bp, Bos taurus; identical to SEQ ID NO: 38647

SEQ ID NO: 119717 - DNA, 201 bp, Bos taurus; identical to SEQ ID NO: 38648

SEQ ID NO: 119718 - DNA, 201 bp, Bos taurus; identical to SEQ ID NO: 38649

SEQ ID NO: 119719 - DNA, 201 bp, Bos taurus; identical to SEQ ID NO: 38650

SEQ ID NO: 119720 - DNA, 201 bp, Bos taurus
tggcgccagctcggggtccccttgctgctggcttggggcccctcgtccctggcaaggtggctgccaccagcgtcatcacaatagtaaagtccaagacggaygcccggtcgtagggacacacttggccaggcgggtctgcaaggggccagtaggcgcatggcaaattcggcagccctgtccccttcttcctccctcctcttc

SEQ ID NO: 119721 - DNA, 201 bp, Bos taurus; identical to SEQ ID NO: 38652

SEQ ID NO: 119722 - DNA, 201 bp, Bos taurus; identical to SEQ ID NO: 38657

SEQ ID NO: 119723 - DNA, 201 bp, Bos taurus
acagccatggcagtctccagacccgtcctggtctccctagcccttgaggggctttgatactcaccagcccaggagccagccaggccaggttcagatccacrcccagagactggtctgaagggcattcagcccaagtagcccaaagccagcctggcagctgatcaccaggctccaccccgattgtggccaaagcacccagca

SEQ ID NO: 119724 - DNA, 201 bp, Bos taurus; identical to SEQ ID NO: 38658

SEQ ID NO: 119725 - DNA, 201 bp, Bos taurus; identical to SEQ ID NO: 38660

SEQ ID NO: 119726 - DNA, 201 bp, Bos taurus; identical to SEQ ID NO: 38661

SEQ ID NO: 119727 - DNA, 201 bp, Bos taurus; identical to SEQ ID NO: 38662

SEQ ID NO: 119728 - DNA, 201 bp, Bos taurus; identical to SEQ ID NO: 38663

SEQ ID NO: 119729 - DNA, 201 bp, Bos taurus; identical to SEQ ID NO: 38664

SEQ ID NO: 119730 - DNA, 201 bp, Bos taurus; identical to SEQ ID NO: 38665

SEQ ID NO: 119731 - DNA, 201 bp, Bos taurus; identical to SEQ ID NO: 38666

SEQ ID NO: 119732 - DNA, 201 bp, Bos taurus; identical to SEQ ID NO: 78854

SEQ ID NO: 119733 - DNA, 201 bp, Bos taurus; identical to SEQ ID NO: 38667

SEQ ID NO: 119734 - DNA, 201 bp, Bos taurus; identical to SEQ ID NO: 38668

SEQ ID NO: 119735 - DNA, 201 bp, Bos taurus
aaaattcctaagcagcctggcaggctggaaactcaggcaggatttatgctgccgtgttgaggaagaacttcttcttctcctgaaaaccccagtgagtgctytgaaggccttcagcaggttggatgaggcccacccaccctcgttattgaagatctcctgttcatgaagtcaattggtcatggatgggagctgtaactgcac

SEQ ID NO: 119736 - DNA, 201 bp, Bos taurus; identical to SEQ ID NO: 78859

SEQ ID NO: 119737 - DNA, 201 bp, Bos taurus; identical to SEQ ID NO: 78860

SEQ ID NO: 119738 - DNA, 201 bp, Bos taurus; identical to SEQ ID NO: 38674

SEQ ID NO: 119739 - DNA, 201 bp, Bos taurus; identical to SEQ ID NO: 78863

SEQ ID NO: 119740 - DNA, 201 bp, Bos taurus; identical to SEQ ID NO: 38675

SEQ ID NO: 119741 - DNA, 201 bp, Bos taurus; identical to SEQ ID NO: 38676

SEQ ID NO: 119742 - DNA, 201 bp, Bos taurus; identical to SEQ ID NO: 78864

SEQ ID NO: 119743 - DNA, 201 bp, Bos taurus; identical to SEQ ID NO: 38679

SEQ ID NO: 119744 - DNA, 201 bp, Bos taurus; identical to SEQ ID NO: 38681

SEQ ID NO: 119745 - DNA, 201 bp, Bos taurus; identical to SEQ ID NO: 38682

SEQ ID NO: 119746 - DNA, 201 bp, Bos taurus; identical to SEQ ID NO: 78868

SEQ ID NO: 119747 - DNA, 201 bp, Bos taurus; identical to SEQ ID NO: 78869

SEQ ID NO: 119748 - DNA, 201 bp, Bos taurus; identical to SEQ ID NO: 78870

SEQ ID NO: 119749 - DNA, 201 bp, Bos taurus; identical to SEQ ID NO: 38683

SEQ ID NO: 119750 - DNA, 201 bp, Bos taurus; identical to SEQ ID NO: 38684

SEQ ID NO: 119751 - DNA, 201 bp, Bos taurus; identical to SEQ ID NO: 38685

SEQ ID NO: 119752 - DNA, 201 bp, Bos taurus; identical to SEQ ID NO: 38687

SEQ ID NO: 119753 - DNA, 201 bp, Bos taurus; identical to SEQ ID NO: 78872

SEQ ID NO: 119754 - DNA, 201 bp, Bos taurus; identical to SEQ ID NO: 38688

SEQ ID NO: 119755 - DNA, 201 bp, Bos taurus; identical to SEQ ID NO: 38689

SEQ ID NO: 119756 - DNA, 201 bp, Bos taurus; identical to SEQ ID NO: 38690

SEQ ID NO: 119757 - DNA, 201 bp, Bos taurus; identical to SEQ ID NO: 38691

SEQ ID NO: 119758 - DNA, 201 bp, Bos taurus; identical to SEQ ID NO: 38692

SEQ ID NO: 119759 - DNA, 201 bp, Bos taurus; identical to SEQ ID NO: 38693

SEQ ID NO: 119760 - DNA, 201 bp, Bos taurus; identical to SEQ ID NO: 38694

SEQ ID NO: 119761 - DNA, 201 bp, Bos taurus; identical to SEQ ID NO: 38695

SEQ ID NO: 119762 - DNA, 201 bp, Bos taurus; identical to SEQ ID NO: 38696

SEQ ID NO: 119763 - DNA, 201 bp, Bos taurus; identical to SEQ ID NO: 38697

SEQ ID NO: 119764 - DNA, 201 bp, Bos taurus; identical to SEQ ID NO: 38698

SEQ ID NO: 119765 - DNA, 201 bp, Bos taurus; identical to SEQ ID NO: 38699

SEQ ID NO: 119766 - DNA, 201 bp, Bos taurus; identical to SEQ ID NO: 38700

SEQ ID NO: 119767 - DNA, 201 bp, Bos taurus; identical to SEQ ID NO: 38701

SEQ ID NO: 119768 - DNA, 201 bp, Bos taurus; identical to SEQ ID NO: 38702

SEQ ID NO: 119769 - DNA, 201 bp, Bos taurus; identical to SEQ ID NO: 38703

SEQ ID NO: 119770 - DNA, 201 bp, Bos taurus; identical to SEQ ID NO: 38704

SEQ ID NO: 119771 - DNA, 201 bp, Bos taurus; identical to SEQ ID NO: 38705

SEQ ID NO: 119772 - DNA, 201 bp, Bos taurus; identical to SEQ ID NO: 38706

SEQ ID NO: 119773 - DNA, 201 bp, Bos taurus; identical to SEQ ID NO: 38707

SEQ ID NO: 119774 - DNA, 201 bp, Bos taurus; identical to SEQ ID NO: 38708

SEQ ID NO: 119775 - DNA, 201 bp, Bos taurus; identical to SEQ ID NO: 38709

SEQ ID NO: 119776 - DNA, 201 bp, Bos taurus; identical to SEQ ID NO: 38710

SEQ ID NO: 119777 - DNA, 201 bp, Bos taurus; identical to SEQ ID NO: 38711

SEQ ID NO: 119778 - DNA, 201 bp, Bos taurus; identical to SEQ ID NO: 38712

SEQ ID NO: 119779 - DNA, 201 bp, Bos taurus; identical to SEQ ID NO: 38713

SEQ ID NO: 119780 - DNA, 201 bp, Bos taurus; identical to SEQ ID NO: 38714

SEQ ID NO: 119781 - DNA, 201 bp, Bos taurus; identical to SEQ ID NO: 38715

SEQ ID NO: 119782 - DNA, 201 bp, Bos taurus; identical to SEQ ID NO: 38716

SEQ ID NO: 119783 - DNA, 201 bp, Bos taurus; identical to SEQ ID NO: 38717

SEQ ID NO: 119784 - DNA, 201 bp, Bos taurus; identical to SEQ ID NO: 38718

SEQ ID NO: 119785 - DNA, 201 bp, Bos taurus; identical to SEQ ID NO: 38719

SEQ ID NO: 119786 - DNA, 201 bp, Bos taurus; identical to SEQ ID NO: 38720

SEQ ID NO: 119787 - DNA, 201 bp, Bos taurus; identical to SEQ ID NO: 38721

SEQ ID NO: 119788 - DNA, 201 bp, Bos taurus; identical to SEQ ID NO: 38722

SEQ ID NO: 119789 - DNA, 201 bp, Bos taurus; identical to SEQ ID NO: 38723

SEQ ID NO: 119790 - DNA, 201 bp, Bos taurus; identical to SEQ ID NO: 38724

SEQ ID NO: 119791 - DNA, 201 bp, Bos taurus; identical to SEQ ID NO: 38725

SEQ ID NO: 119792 - DNA, 201 bp, Bos taurus; identical to SEQ ID NO: 38726

SEQ ID NO: 119793 - DNA, 201 bp, Bos taurus; identical to SEQ ID NO: 38727

SEQ ID NO: 119794 - DNA, 201 bp, Bos taurus; identical to SEQ ID NO: 38728

SEQ ID NO: 119795 - DNA, 201 bp, Bos taurus; identical to SEQ ID NO: 38729

SEQ ID NO: 119796 - DNA, 201 bp, Bos taurus; identical to SEQ ID NO: 38730

SEQ ID NO: 119797 - DNA, 201 bp, Bos taurus; identical to SEQ ID NO: 38731

SEQ ID NO: 119798 - DNA, 201 bp, Bos taurus; identical to SEQ ID NO: 38732

SEQ ID NO: 119799 - DNA, 201 bp, Bos taurus; identical to SEQ ID NO: 38733

SEQ ID NO: 119800 - DNA, 201 bp, Bos taurus; identical to SEQ ID NO: 38734

SEQ ID NO: 119801 - DNA, 201 bp, Bos taurus; identical to SEQ ID NO: 38735

SEQ ID NO: 119802 - DNA, 201 bp, Bos taurus; identical to SEQ ID NO: 38736

SEQ ID NO: 119803 - DNA, 201 bp, Bos taurus; identical to SEQ ID NO: 38737

SEQ ID NO: 119804 - DNA, 201 bp, Bos taurus; identical to SEQ ID NO: 38738

SEQ ID NO: 119805 - DNA, 201 bp, Bos taurus; identical to SEQ ID NO: 38739

SEQ ID NO: 119806 - DNA, 201 bp, Bos taurus; identical to SEQ ID NO: 38740

SEQ ID NO: 119807 - DNA, 201 bp, Bos taurus; identical to SEQ ID NO: 38741

SEQ ID NO: 119808 - DNA, 201 bp, Bos taurus; identical to SEQ ID NO: 38742

SEQ ID NO: 119809 - DNA, 201 bp, Bos taurus; identical to SEQ ID NO: 38743

SEQ ID NO: 119810 - DNA, 201 bp, Bos taurus; identical to SEQ ID NO: 38744

SEQ ID NO: 119811 - DNA, 201 bp, Bos taurus; identical to SEQ ID NO: 38745

SEQ ID NO: 119812 - DNA, 201 bp, Bos taurus; identical to SEQ ID NO: 38746

SEQ ID NO: 119813 - DNA, 201 bp, Bos taurus; identical to SEQ ID NO: 38747

SEQ ID NO: 119814 - DNA, 201 bp, Bos taurus; identical to SEQ ID NO: 38748

SEQ ID NO: 119815 - DNA, 201 bp, Bos taurus; identical to SEQ ID NO: 38749

SEQ ID NO: 119816 - DNA, 201 bp, Bos taurus; identical to SEQ ID NO: 38751

SEQ ID NO: 119817 - DNA, 201 bp, Bos taurus; identical to SEQ ID NO: 38752

SEQ ID NO: 119818 - DNA, 201 bp, Bos taurus; identical to SEQ ID NO: 38753

SEQ ID NO: 119819 - DNA, 201 bp, Bos taurus; identical to SEQ ID NO: 38754

SEQ ID NO: 119820 - DNA, 201 bp, Bos taurus
tgtctggggaaaccctacagacatatatgaaataccttaacaacatttggccaaaataatcttttttttttttaatgaatacagagacctgaggggacacrgaacagtggaaactcaaaatggggccacaagtcacacagaggctgacgccgggtcatattcttcaggctgtaacaaacagggtggaaggggattccaggc

SEQ ID NO: 119821 - DNA, 201 bp, Bos taurus; identical to SEQ ID NO: 38755

SEQ ID NO: 119822 - DNA, 201 bp, Bos taurus; identical to SEQ ID NO: 38757

SEQ ID NO: 119823 - DNA, 201 bp, Bos taurus; identical to SEQ ID NO: 38758

SEQ ID NO: 119824 - DNA, 201 bp, Bos taurus
tcttgagggggtcaccaggagggcttgtcgactcagtctagtggctgaagctgcctctgctcaaacacctctgggaacctctgggactccactctcagaakgacacacatggccagtagctcatcactccccgcctgacccctgtcagcctttgagagtgtggtgtgattgtttaggggctgcagcaaaaagacacagatg

SEQ ID NO: 119825 - DNA, 201 bp, Bos taurus; identical to SEQ ID NO: 38762

SEQ ID NO: 119826 - DNA, 201 bp, Bos taurus; identical to SEQ ID NO: 38763

SEQ ID NO: 119827 - DNA, 201 bp, Bos taurus
gaaggctggattccattgcctcaccatcctctcttagggcccttggcatcgtctgcatagaaggaggtgggttggcctgaacccacctttcctctctgcaygcttctgctttctctcccagaaatggagctgtgccagagcaaccaggccaagagcatcctcccaggacaaccgagaagtgtgagcaggtgctggggctcc

SEQ ID NO: 119828 - DNA, 201 bp, Bos taurus
cttgaccgttcaagagagagaaggacgcgtccagggccggagacggggcccaggcgcgcccgccaacgagcccggactcggccgggctggccaagcaccakagcttagagcgtggggaccccggaaggagaggaacgcccttaacggtgactcaggagtttggactacgagccacaggcactccggcgccgaagacctttt

SEQ ID NO: 119829 - DNA, 201 bp, Bos taurus; identical to SEQ ID NO: 38764

SEQ ID NO: 119830 - DNA, 201 bp, Bos taurus; identical to SEQ ID NO: 38765

SEQ ID NO: 119831 - DNA, 201 bp, Bos taurus; identical to SEQ ID NO: 38766

SEQ ID NO: 119832 - DNA, 201 bp, Bos taurus; identical to SEQ ID NO: 38767

SEQ ID NO: 119833 - DNA, 201 bp, Bos taurus; identical to SEQ ID NO: 38768

SEQ ID NO: 119834 - DNA, 201 bp, Bos taurus; identical to SEQ ID NO: 38769

SEQ ID NO: 119835 - DNA, 201 bp, Bos taurus; identical to SEQ ID NO: 38770

SEQ ID NO: 119836 - DNA, 201 bp, Bos taurus; identical to SEQ ID NO: 38771

SEQ ID NO: 119837 - DNA, 201 bp, Bos taurus; identical to SEQ ID NO: 38772

SEQ ID NO: 119838 - DNA, 201 bp, Bos taurus; identical to SEQ ID NO: 38773

SEQ ID NO: 119839 - DNA, 201 bp, Bos taurus; identical to SEQ ID NO: 38775

SEQ ID NO: 119840 - DNA, 201 bp, Bos taurus; identical to SEQ ID NO: 38776

SEQ ID NO: 119841 - DNA, 201 bp, Bos taurus
gctacgatagcagactgtctttgcatgaagagcattgatagtcctgctccccaagtcccggatctaagccccctactgtgaaacgtggaaggagtcagcgrtacaggaaaccttagttcagctagttaccagtaaacatatacaaggtgctgcttcttagagagctgaaaattataaactcagttaagaagagtcctggtc

SEQ ID NO: 119842 - DNA, 201 bp, Bos taurus
acagacccagtgatttatccacaaaactttctcacatcttgcaatgcacgtggcagcccaagacaaaggcttccacgttcaccagcgaaggctccacatcycacaccaagcagttacttcttgctcttctcttgtgggtcaaagcctggctccttctctaaacctctctattatcttcctcatatacattctaaatatcga

SEQ ID NO: 119843 - DNA, 201 bp, Bos taurus
cttatgggttcagagtaggggccgtgatgtgggtgtgaccgtccccctctgccccagaaaagaaggagtgcagggctgcccgctgctgggccgggggccaygtgaccctgcaggctgtgccagacagtgactgagcgggcagggggtgccagtttcagcccatccctgcaggacaggtgatctagaaagtgacttctgcct

SEQ ID NO: 119844 - DNA, 201 bp, Bos taurus; identical to SEQ ID NO: 38778

SEQ ID NO: 119845 - DNA, 201 bp, Bos taurus; identical to SEQ ID NO: 38779

SEQ ID NO: 119846 - DNA, 201 bp, Bos taurus
actgacaaaccaagtttgggcccaagttaaatctagctatgcacatttctcaagcctttttctaataactttagaagtgctatcgtcataaagtactgggraacagcagaaaatgtgggcctagatctgtagaagtcactggctcttttatgatattactcttggtgcttggggttttgaatttttttattttttggctgc

SEQ ID NO: 119847 - DNA, 201 bp, Bos taurus; identical to SEQ ID NO: 78975

SEQ ID NO: 119848 - DNA, 201 bp, Bos taurus; identical to SEQ ID NO: 38780

SEQ ID NO: 119849 - DNA, 201 bp, Bos taurus; identical to SEQ ID NO: 38781

SEQ ID NO: 119850 - DNA, 201 bp, Bos taurus; identical to SEQ ID NO: 38782

SEQ ID NO: 119851 - DNA, 201 bp, Bos taurus; identical to SEQ ID NO: 38784

SEQ ID NO: 119852 - DNA, 201 bp, Bos taurus; identical to SEQ ID NO: 78982

SEQ ID NO: 119853 - DNA, 201 bp, Bos taurus
tgtatttaaaagccaactagaacaggaaggagctggcataaatgaagagctgaaagatggatggctgagagttacaagatcataagtaatgagaaaggccyggctgctgggcacacctcggtttttgctctgacagaagacatacaacgggagaacacatctgttaatgtccttcacgagttcgtctgaacttgaagcgga

SEQ ID NO: 119854 - DNA, 201 bp, Bos taurus; identical to SEQ ID NO: 38792

SEQ ID NO: 119855 - DNA, 201 bp, Bos taurus; identical to SEQ ID NO: 38793

SEQ ID NO: 119856 - DNA, 201 bp, Bos taurus
ctccagggcccacgagtgtgaaaatcgggatcacttcgggaggcctgcctggccttgccccatctgtccatgccccagcacccttccctcccacctcctgyatcagccgctgcgcaggagggggccagcttcattttaacttcagccgaatcaaagtctcggagagggagtgggtatcactgtgggtgaggtgaggctcct

SEQ ID NO: 119857 - DNA, 201 bp, Bos taurus
acacggccctgcccccgctccacccttctcccgattcccagggagattgcacacccactcctgcgccggaatccagctgcgctccgctaggactgtctgcrcagaagctgggggcggggcccagcaccaagcgcacagtctggcccccgcgggtcacccctcccctctcgtcacctcccaaggaaaagggagccgcaagcc

SEQ ID NO: 119858 - DNA, 201 bp, Bos taurus
ggaaaccttcagtgaatccagaggctgggtcatgcaccccaaacctctgagcacagagtgcagaacatccgagctgacacccaagtggcagttcctgtccygtaatcctgttttcagctcactgccttcagctctctgacccaccattctctcctccacccagctgggctccaccatccacagcctgccccttcttgcttc

SEQ ID NO: 119859 - DNA, 201 bp, Bos taurus
acaggggcctgagatgtgtgtctccctacatcgcagagttggggcagccccttggggacgtgctctctggtcccagcccttgggtctccagctctcagagsaaacctgatcaggcctgctgactagttcctgcatctgaggacccctttgatgtgtgggtccgcgtgggagggagactggagtggaaatatgtgttttcct

SEQ ID NO: 119860 - DNA, 201 bp, Bos taurus; identical to SEQ ID NO: 38797

SEQ ID NO: 119861 - DNA, 201 bp, Bos taurus; identical to SEQ ID NO: 79000

SEQ ID NO: 119862 - DNA, 201 bp, Bos taurus
agcacacaacacagtctctttagaaaaacaacacgcctgaaccactgagggaaaagggttggtttccatggcaacatcaaggccatgagaagcagtctggmatggcggggtgttcatctgactctgctcttttgtcagaaatgatgtgtttcagagaacccagccccagagatcacgagtccaagttgcctggagagatgg

SEQ ID NO: 119863 - DNA, 201 bp, Bos taurus; identical to SEQ ID NO: 79003

SEQ ID NO: 119864 - DNA, 201 bp, Bos taurus
tagagcagctgccaagtgtgagttcttggccctgaattcaagagtaagccatagtagagtgaaaggtttattcagggaggaaatacacaccatagacagartatgggccatctcagaaggcaagagagttacctgggtatggggttgccagtttttataagggtgggtaatttcataatctaataagtgggaggaattgta

SEQ ID NO: 119865 - DNA, 201 bp, Bos taurus; identical to SEQ ID NO: 79004

SEQ ID NO: 119866 - DNA, 201 bp, Bos taurus
tcagagagactgagtaactttcccaatggcacacagctcttaagcggcaagacccatgtccttcttccccacttgctgtccttctggtggcaggtctgacygggtccttgggaacatgagtttggcacaaaacagaagcagtctttaagatgcccacagcctgtggaactggcaaacacattgagagaaaatgaaaacaaa

SEQ ID NO: 119867 - DNA, 201 bp, Bos taurus; identical to SEQ ID NO: 79005

SEQ ID NO: 119868 - DNA, 201 bp, Bos taurus; identical to SEQ ID NO: 79006

SEQ ID NO: 119869 - DNA, 201 bp, Bos taurus; identical to SEQ ID NO: 38800

SEQ ID NO: 119870 - DNA, 201 bp, Bos taurus; identical to SEQ ID NO: 38802

SEQ ID NO: 119871 - DNA, 201 bp, Bos taurus
gaactacaggtgcttatgtattatgtaaggcatcctctactattttagttattttaattgagacaaaggactcagtgtggcctactggttttctccagctktttgcttcctgataggtgtgggagtaactaaagaacctgagaagtattgtcaaatatgtgggggaaaagtgagcagatggcatcctgctgtccacatgtt

SEQ ID NO: 119872 - DNA, 201 bp, Bos taurus
ttctctaaagtcaaagctcaattaaaaaaaagtccccattgctatttaaaaaaaatgctttactttattgtacccatacccgtgtttgtgtttgaatgatmaacacaaaaaatagtgatttaagaaaataaaattataggtccttaataaatttatattggaggagaaggaaatggcattataagaaagagtttttataat

SEQ ID NO: 119873 - DNA, 201 bp, Bos taurus
gcccagcggtgggtaatcaagaggtggacaagccacagggcaggcccttgacctacaaggactccactcagcatcgcctttccttcttgtttcaggcaccrtccatccagtgcagagaggcctcctagaagctgggggagtgctcagggggctaactttcagtctgactgtggcctggcgggctcaggggttgtcttctcc

SEQ ID NO: 119874 - DNA, 201 bp, Bos taurus
ctggctctataagcaaagaagagctgaccaaatattgtcctgcattagagggagcacagagaaggaaagagaaaagatctgtgtgtcccagaagttggatyttcaaaaaccaaatgcctccttgaaagtgttgcaacttactttaatatactgcagagtagacagtttgaatcaagtgtgtgatttgctggttttaatcaa

SEQ ID NO: 119875 - DNA, 201 bp, Bos taurus; identical to SEQ ID NO: 38807

SEQ ID NO: 119876 - DNA, 201 bp, Bos taurus; identical to SEQ ID NO: 79016

SEQ ID NO: 119877 - DNA, 201 bp, Bos taurus; identical to SEQ ID NO: 38809

SEQ ID NO: 119878 - DNA, 201 bp, Bos taurus; identical to SEQ ID NO: 38811

SEQ ID NO: 119879 - DNA, 201 bp, Bos taurus; identical to SEQ ID NO: 38812

SEQ ID NO: 119880 - DNA, 201 bp, Bos taurus; identical to SEQ ID NO: 38816

SEQ ID NO: 119881 - DNA, 201 bp, Bos taurus
gaccgaacccatgactcctgcattagcagctgaattctttaccactgagccagctgggatacaagctactacacataaaatagatgaataacaaggtcccrctgtatagcacggggaactatattcagtgtcctataataaaccataacagaaaagagtataaaaaagaaaaaactatatatatagttatgtgtgtgtgtg

SEQ ID NO: 119882 - DNA, 201 bp, Bos taurus
cagggtaacgtgcatgtgaattacctgcagatttgtcagaatgcagattctgactcagtgtcagatggaggctgataccctgcatttctgaccagctccargcggtgccactgctgctggcctgtggaccatactccgagcagccaaatgagagattcaaagtgtcccgttaggaacaaaaagagagaaatattcatattg

SEQ ID NO: 119883 - DNA, 201 bp, Bos taurus
ggacgtgcagcggggcagagaagttgagggcagcctagtggaaaagcaccctgtagcatttggcaggctccagattttccccccgcccccatccaagggarttttcacacggcctctgtataggttactctttcccttacttttaaaatatgaattttccaagtcaagattctgggaatgggagtctcaggtgcccttttg

SEQ ID NO: 119884 - DNA, 201 bp, Bos taurus
ggagtcccggagcctcggtgttaggaggcacggattcgaggccgcagctctaggcgccgcaaagacaccgaagggtcgctaagccgcagcccaacgacccrtgttgagcacgcctggcctgtgcggctgggatgttaactgtgaggtgtgtgttttgggaagaaagcaggacagacgtttctcacagagcggcaggtttct

SEQ ID NO: 119885 - DNA, 201 bp, Bos taurus; identical to SEQ ID NO: 38817

SEQ ID NO: 119886 - DNA, 201 bp, Bos taurus
atggatgaatgaatgaacaaacaaaagcaaggggcccttcttgcctttccccctcccctggctacagcgcagacatggcagcaagagctggggcagctgtygcagactgtgtgatgaagctgagtatcaaggatggcaatgggaccacacggagtgactcgaattcctggtctcaggtccctggacagcctcttggggcag

SEQ ID NO: 119887 - DNA, 201 bp, Bos taurus
gttgcctctgtagttccctctgttgtcctcttggcagtgtttcccagattgagatgatttgggccaggacgaaatgggactcaggaattttaacatgttcracaattatcttggttcttatcatcatggatccttgcagatccaaccagactaccatatctcttttaatttgcaatgttgtgttaattactgctgtatagc

SEQ ID NO: 119888 - DNA, 201 bp, Bos taurus
ctgaaggcttgctattccctcacaatcccattaacatgtgaaagcaaagatctcagacatctcagatcaaattctactagacatacagatgcttattaaaygtgttaacatgcacaaagcagtgtatatggctgcccatcccatgagcatgaagacgctgacctgacaggaggtggccctgacccattctggagccagaat

SEQ ID NO: 119889 - DNA, 201 bp, Bos taurus
ctttgatgttagtatcatttgaagctatcaagatacagaagtatatagaactcgctaagaattttgtatttccaaagaaaatcttggaacaaaaggctatmggtaatttttactttgttatgtcttttaactatcatataataagctataaacaaaaaggaaaacacacacaccccccccaaaaaaaggaaaaacatcttc

SEQ ID NO: 119890 - DNA, 201 bp, Bos taurus
tgaatcaactcttcacatgacgtgcccaaagtaactatttagtccttgatgtcatcagggaacttcaggttccaaagaattctctaggccctttctaactyaaagatccctaaacaagctgcaagtcatcactagggaatctgtgaaaaatgcacaacctgaggccttgtcggaacctactcaatcagggtcttcatttta

SEQ ID NO: 119891 - DNA, 201 bp, Bos taurus; identical to SEQ ID NO: 38819

SEQ ID NO: 119892 - DNA, 201 bp, Bos taurus; identical to SEQ ID NO: 38820

SEQ ID NO: 119893 - DNA, 201 bp, Bos taurus; identical to SEQ ID NO: 38821

SEQ ID NO: 119894 - DNA, 201 bp, Bos taurus; identical to SEQ ID NO: 38822

SEQ ID NO: 119895 - DNA, 201 bp, Bos taurus; identical to SEQ ID NO: 38823

SEQ ID NO: 119896 - DNA, 201 bp, Bos taurus; identical to SEQ ID NO: 38824

SEQ ID NO: 119897 - DNA, 201 bp, Bos taurus; identical to SEQ ID NO: 38825

SEQ ID NO: 119898 - DNA, 201 bp, Bos taurus; identical to SEQ ID NO: 38826

SEQ ID NO: 119899 - DNA, 201 bp, Bos taurus; identical to SEQ ID NO: 38828

SEQ ID NO: 119900 - DNA, 201 bp, Bos taurus; identical to SEQ ID NO: 38829

SEQ ID NO: 119901 - DNA, 201 bp, Bos taurus; identical to SEQ ID NO: 38830

SEQ ID NO: 119902 - DNA, 201 bp, Bos taurus; identical to SEQ ID NO: 38831

SEQ ID NO: 119903 - DNA, 201 bp, Bos taurus; identical to SEQ ID NO: 38832

SEQ ID NO: 119904 - DNA, 201 bp, Bos taurus; identical to SEQ ID NO: 38833

SEQ ID NO: 119905 - DNA, 201 bp, Bos taurus; identical to SEQ ID NO: 38834

SEQ ID NO: 119906 - DNA, 201 bp, Bos taurus; identical to SEQ ID NO: 38835

SEQ ID NO: 119907 - DNA, 201 bp, Bos taurus; identical to SEQ ID NO: 38836

SEQ ID NO: 119908 - DNA, 201 bp, Bos taurus; identical to SEQ ID NO: 38837

SEQ ID NO: 119909 - DNA, 201 bp, Bos taurus; identical to SEQ ID NO: 38838

SEQ ID NO: 119910 - DNA, 201 bp, Bos taurus; identical to SEQ ID NO: 38839

SEQ ID NO: 119911 - DNA, 201 bp, Bos taurus; identical to SEQ ID NO: 38840

SEQ ID NO: 119912 - DNA, 201 bp, Bos taurus; identical to SEQ ID NO: 38841

SEQ ID NO: 119913 - DNA, 201 bp, Bos taurus; identical to SEQ ID NO: 38842

SEQ ID NO: 119914 - DNA, 201 bp, Bos taurus; identical to SEQ ID NO: 38843

SEQ ID NO: 119915 - DNA, 201 bp, Bos taurus; identical to SEQ ID NO: 38844

SEQ ID NO: 119916 - DNA, 201 bp, Bos taurus; identical to SEQ ID NO: 38845

SEQ ID NO: 119917 - DNA, 201 bp, Bos taurus; identical to SEQ ID NO: 38846

SEQ ID NO: 119918 - DNA, 201 bp, Bos taurus; identical to SEQ ID NO: 38847

SEQ ID NO: 119919 - DNA, 201 bp, Bos taurus; identical to SEQ ID NO: 38848

SEQ ID NO: 119920 - DNA, 201 bp, Bos taurus; identical to SEQ ID NO: 79059

SEQ ID NO: 119921 - DNA, 201 bp, Bos taurus; identical to SEQ ID NO: 79060

SEQ ID NO: 119922 - DNA, 201 bp, Bos taurus
aagttaaacctggctcttttacaaagagtgtagaggcgggtgttgaccttgagagttttgtcaaactggtttggaatataagcttgcacagacctagagtyaagtaactgagcagtgaaggatattcatagcaaactgtgtgacctcagtccccttggggtttggttatgctatggagggaatcatgtctcaccaatggac

SEQ ID NO: 119923 - DNA, 201 bp, Bos taurus; identical to SEQ ID NO: 38851

SEQ ID NO: 119924 - DNA, 201 bp, Bos taurus; identical to SEQ ID NO: 38852

SEQ ID NO: 119925 - DNA, 201 bp, Bos taurus; identical to SEQ ID NO: 38853

SEQ ID NO: 119926 - DNA, 201 bp, Bos taurus; identical to SEQ ID NO: 38854

SEQ ID NO: 119927 - DNA, 201 bp, Bos taurus; identical to SEQ ID NO: 38855

SEQ ID NO: 119928 - DNA, 201 bp, Bos taurus; identical to SEQ ID NO: 38856

SEQ ID NO: 119929 - DNA, 201 bp, Bos taurus; identical to SEQ ID NO: 38857

SEQ ID NO: 119930 - DNA, 201 bp, Bos taurus; identical to SEQ ID NO: 38858

SEQ ID NO: 119931 - DNA, 201 bp, Bos taurus; identical to SEQ ID NO: 38859

SEQ ID NO: 119932 - DNA, 201 bp, Bos taurus; identical to SEQ ID NO: 38860

SEQ ID NO: 119933 - DNA, 201 bp, Bos taurus; identical to SEQ ID NO: 38861

SEQ ID NO: 119934 - DNA, 201 bp, Bos taurus; identical to SEQ ID NO: 38862

SEQ ID NO: 119935 - DNA, 201 bp, Bos taurus; identical to SEQ ID NO: 38863

SEQ ID NO: 119936 - DNA, 201 bp, Bos taurus; identical to SEQ ID NO: 38864

SEQ ID NO: 119937 - DNA, 201 bp, Bos taurus; identical to SEQ ID NO: 38865

SEQ ID NO: 119938 - DNA, 201 bp, Bos taurus; identical to SEQ ID NO: 38866

SEQ ID NO: 119939 - DNA, 201 bp, Bos taurus; identical to SEQ ID NO: 38867

SEQ ID NO: 119940 - DNA, 201 bp, Bos taurus; identical to SEQ ID NO: 38869

SEQ ID NO: 119941 - DNA, 201 bp, Bos taurus; identical to SEQ ID NO: 38870

SEQ ID NO: 119942 - DNA, 201 bp, Bos taurus; identical to SEQ ID NO: 38871

SEQ ID NO: 119943 - DNA, 201 bp, Bos taurus; identical to SEQ ID NO: 38872

SEQ ID NO: 119944 - DNA, 201 bp, Bos taurus; identical to SEQ ID NO: 38874

SEQ ID NO: 119945 - DNA, 201 bp, Bos taurus; identical to SEQ ID NO: 38875

SEQ ID NO: 119946 - DNA, 201 bp, Bos taurus; identical to SEQ ID NO: 38876

SEQ ID NO: 119947 - DNA, 201 bp, Bos taurus; identical to SEQ ID NO: 38877

SEQ ID NO: 119948 - DNA, 201 bp, Bos taurus; identical to SEQ ID NO: 38878

SEQ ID NO: 119949 - DNA, 201 bp, Bos taurus; identical to SEQ ID NO: 38879

SEQ ID NO: 119950 - DNA, 201 bp, Bos taurus; identical to SEQ ID NO: 38880

SEQ ID NO: 119951 - DNA, 201 bp, Bos taurus; identical to SEQ ID NO: 38881

SEQ ID NO: 119952 - DNA, 201 bp, Bos taurus; identical to SEQ ID NO: 38882

SEQ ID NO: 119953 - DNA, 201 bp, Bos taurus; identical to SEQ ID NO: 38883

SEQ ID NO: 119954 - DNA, 201 bp, Bos taurus; identical to SEQ ID NO: 38884

SEQ ID NO: 119955 - DNA, 201 bp, Bos taurus; identical to SEQ ID NO: 38885

SEQ ID NO: 119956 - DNA, 201 bp, Bos taurus; identical to SEQ ID NO: 38886

SEQ ID NO: 119957 - DNA, 201 bp, Bos taurus; identical to SEQ ID NO: 38887

SEQ ID NO: 119958 - DNA, 201 bp, Bos taurus; identical to SEQ ID NO: 38888

SEQ ID NO: 119959 - DNA, 201 bp, Bos taurus; identical to SEQ ID NO: 38889

SEQ ID NO: 119960 - DNA, 201 bp, Bos taurus; identical to SEQ ID NO: 38890

SEQ ID NO: 119961 - DNA, 201 bp, Bos taurus; identical to SEQ ID NO: 38891

SEQ ID NO: 119962 - DNA, 201 bp, Bos taurus; identical to SEQ ID NO: 38892

SEQ ID NO: 119963 - DNA, 201 bp, Bos taurus; identical to SEQ ID NO: 38893

SEQ ID NO: 119964 - DNA, 201 bp, Bos taurus; identical to SEQ ID NO: 38894

SEQ ID NO: 119965 - DNA, 201 bp, Bos taurus; identical to SEQ ID NO: 38895

SEQ ID NO: 119966 - DNA, 201 bp, Bos taurus; identical to SEQ ID NO: 38896

SEQ ID NO: 119967 - DNA, 201 bp, Bos taurus; identical to SEQ ID NO: 38897

SEQ ID NO: 119968 - DNA, 201 bp, Bos taurus; identical to SEQ ID NO: 38898

SEQ ID NO: 119969 - DNA, 201 bp, Bos taurus; identical to SEQ ID NO: 38899

SEQ ID NO: 119970 - DNA, 201 bp, Bos taurus; identical to SEQ ID NO: 38900

SEQ ID NO: 119971 - DNA, 201 bp, Bos taurus; identical to SEQ ID NO: 38901

SEQ ID NO: 119972 - DNA, 201 bp, Bos taurus; identical to SEQ ID NO: 38902

SEQ ID NO: 119973 - DNA, 201 bp, Bos taurus; identical to SEQ ID NO: 38903

SEQ ID NO: 119974 - DNA, 201 bp, Bos taurus; identical to SEQ ID NO: 38904

SEQ ID NO: 119975 - DNA, 201 bp, Bos taurus; identical to SEQ ID NO: 38905

SEQ ID NO: 119976 - DNA, 201 bp, Bos taurus; identical to SEQ ID NO: 38906

SEQ ID NO: 119977 - DNA, 201 bp, Bos taurus; identical to SEQ ID NO: 38907

SEQ ID NO: 119978 - DNA, 201 bp, Bos taurus; identical to SEQ ID NO: 38908

SEQ ID NO: 119979 - DNA, 201 bp, Bos taurus; identical to SEQ ID NO: 38909

SEQ ID NO: 119980 - DNA, 201 bp, Bos taurus; identical to SEQ ID NO: 38910

SEQ ID NO: 119981 - DNA, 201 bp, Bos taurus; identical to SEQ ID NO: 38911

SEQ ID NO: 119982 - DNA, 201 bp, Bos taurus; identical to SEQ ID NO: 38912

SEQ ID NO: 119983 - DNA, 201 bp, Bos taurus; identical to SEQ ID NO: 38913

SEQ ID NO: 119984 - DNA, 201 bp, Bos taurus; identical to SEQ ID NO: 38914

SEQ ID NO: 119985 - DNA, 201 bp, Bos taurus; identical to SEQ ID NO: 38915

SEQ ID NO: 119986 - DNA, 201 bp, Bos taurus; identical to SEQ ID NO: 38916

SEQ ID NO: 119987 - DNA, 201 bp, Bos taurus; identical to SEQ ID NO: 38917

SEQ ID NO: 119988 - DNA, 201 bp, Bos taurus; identical to SEQ ID NO: 38918

SEQ ID NO: 119989 - DNA, 201 bp, Bos taurus; identical to SEQ ID NO: 38919

SEQ ID NO: 119990 - DNA, 201 bp, Bos taurus; identical to SEQ ID NO: 38920

SEQ ID NO: 119991 - DNA, 201 bp, Bos taurus; identical to SEQ ID NO: 38921

SEQ ID NO: 119992 - DNA, 201 bp, Bos taurus; identical to SEQ ID NO: 38922

SEQ ID NO: 119993 - DNA, 201 bp, Bos taurus; identical to SEQ ID NO: 38923

SEQ ID NO: 119994 - DNA, 201 bp, Bos taurus; identical to SEQ ID NO: 38924

SEQ ID NO: 119995 - DNA, 201 bp, Bos taurus; identical to SEQ ID NO: 38925

SEQ ID NO: 119996 - DNA, 201 bp, Bos taurus; identical to SEQ ID NO: 38926

SEQ ID NO: 119997 - DNA, 201 bp, Bos taurus; identical to SEQ ID NO: 38927

SEQ ID NO: 119998 - DNA, 201 bp, Bos taurus; identical to SEQ ID NO: 38928

SEQ ID NO: 119999 - DNA, 201 bp, Bos taurus; identical to SEQ ID NO: 38929

SEQ ID NO: 120000 - DNA, 201 bp, Bos taurus; identical to SEQ ID NO: 38930

SEQ ID NO: 120001 - DNA, 201 bp, Bos taurus; identical to SEQ ID NO: 38931

SEQ ID NO: 120002 - DNA, 201 bp, Bos taurus; identical to SEQ ID NO: 38932

SEQ ID NO: 120003 - DNA, 201 bp, Bos taurus; identical to SEQ ID NO: 38933

SEQ ID NO: 120004 - DNA, 201 bp, Bos taurus; identical to SEQ ID NO: 38934

SEQ ID NO: 120005 - DNA, 201 bp, Bos taurus; identical to SEQ ID NO: 38935

SEQ ID NO: 120006 - DNA, 201 bp, Bos taurus; identical to SEQ ID NO: 38936

SEQ ID NO: 120007 - DNA, 201 bp, Bos taurus; identical to SEQ ID NO: 38937

SEQ ID NO: 120008 - DNA, 201 bp, Bos taurus; identical to SEQ ID NO: 38938

SEQ ID NO: 120009 - DNA, 201 bp, Bos taurus; identical to SEQ ID NO: 38939

SEQ ID NO: 120010 - DNA, 201 bp, Bos taurus; identical to SEQ ID NO: 38940

SEQ ID NO: 120011 - DNA, 201 bp, Bos taurus; identical to SEQ ID NO: 38941

SEQ ID NO: 120012 - DNA, 201 bp, Bos taurus; identical to SEQ ID NO: 38942

SEQ ID NO: 120013 - DNA, 201 bp, Bos taurus; identical to SEQ ID NO: 38943

SEQ ID NO: 120014 - DNA, 201 bp, Bos taurus; identical to SEQ ID NO: 79155

SEQ ID NO: 120015 - DNA, 201 bp, Bos taurus; identical to SEQ ID NO: 38944

SEQ ID NO: 120016 - DNA, 201 bp, Bos taurus
agactgcaaaaatttaaagcatcaggcaaagttgtacataggaagaaaacatgtaacagctattgtttactaaatatgcttctttagatattgaatgtaaragggatagcaaaatataggtgaagtgtgagataggatggaaatagcaggcatgaaaagacatatttgcatttatgctttgctttctacaaacaaatatac

SEQ ID NO: 120017 - DNA, 201 bp, Bos taurus
ttgaaaactacagaattttttgctggcaaacaacagaacttgctcattttggcagaaaaagaacctacttgcctgcactgcctttttaagcttttgaaagmtgaaacatgtagactgtattaaaaagtataaagaagtaacattttaaatacttgctaactaactttcattgtgtcctcatgtgtgtccataggaggcaaa

SEQ ID NO: 120018 - DNA, 201 bp, Bos taurus
ccacaaaacaccacaagacaactccttgctggcagtggtagaacttctacaattagcgattaactgtctgaaagcttttcaggttaaaaaatgtatccttycagtttaaacaatacttttcatataaatggtagacattttcaattccttcagatcttgcaaggatttggtctaagttatatactgctccctcttacagta

SEQ ID NO: 120019 - DNA, 201 bp, Bos taurus
ttttgctttagaagcagtgtgtaaaattttgatattaccccctttccaaaataaaatcagtaaaaacaggcagtttagtgaaacaattcactaatatcacytgatagcaataaagagaaatgctaattatttctaaaggttaattacatgatactccaaatttataaaaagaaaatccctatgcatagttatgatcaaaat

SEQ ID NO: 120020 - DNA, 201 bp, Bos taurus
attctgattctatcaaaactgtgccaccaaatgattttacattgtctactatatgttttaccagtatgtgctactgtaagaaagtgcattatacaataagytaacattaatacaatatggatgtattagtagtagatgtattatttcactaaataataaattggatatataaatttaaaacaatagctattattttgcaag

SEQ ID NO: 120021 - DNA, 201 bp, Bos taurus; identical to SEQ ID NO: 38947

SEQ ID NO: 120022 - DNA, 201 bp, Bos taurus; identical to SEQ ID NO: 38948

SEQ ID NO: 120023 - DNA, 201 bp, Bos taurus
aatatatgtgtacagagaaaattcttctataatttttctaatatttgaagacgttcaaacattctgaaatttacagtgaaagaaatttacaatgaacaccygccacctaccattaatattatactataatatcttagattgattcaacaatcaatttaacatatatctgctgattaatccagctcttttccatctatgctt

SEQ ID NO: 120024 - DNA, 201 bp, Bos taurus; identical to SEQ ID NO: 38949

SEQ ID NO: 120025 - DNA, 201 bp, Bos taurus; identical to SEQ ID NO: 38952

SEQ ID NO: 120026 - DNA, 201 bp, Bos taurus
atgataactcaaagcttgaaatttgtggctctgcagaaaagctgtcttttagctaacttccctcttacttgtgtagtctttctttaatgagttcttcaaayacctatggacataatctactataattagagaaaaattttaacctgaaccaaaactgaatgactttggcactatatattattttgaatcattgaagttttg

SEQ ID NO: 120027 - DNA, 201 bp, Bos taurus; identical to SEQ ID NO: 38954

SEQ ID NO: 120028 - DNA, 201 bp, Bos taurus
cttcatctgttggttctccgatcttttccagtggaaggcaaaacatgttgattattattaaagtcagtatgactttagcatcaatttacctgatgcctctyaaggcaatgcttcctatctctaggggagagggattatatatcaatcactggtttaaaatatataccatgtaatgtagactagtcatgacatgtgtaggat

SEQ ID NO: 120029 - DNA, 201 bp, Bos taurus
taagttaaataagtaaggttagtaactttactagagttccaggaaataaatcattgttttagctcctgaaagaaagtagcatacagtgaatgtgaccattyctatggagtaaaggtataagacaggctccttgtttccattgtcagagtccatctccattatttcatatgtcatgatgttcaataagagatgcaatcagag

SEQ ID NO: 120030 - DNA, 201 bp, Bos taurus
atgtatattcacatactcttcttaacagaaagatacttagacactcaccaagaaagaagttacaatttgtgttaaataactgcattgaacttgtgggccawattctttagactactactacgcttttccttctccattgatcctgatgtggattctcatgaatatcacaaataaaatctttgaaaatatgttgcttatttc

SEQ ID NO: 120031 - DNA, 201 bp, Bos taurus
acagattttacactttctccattgtaatccattaaagatacagtaaggccttgaacaacctgggggttagaggcactgagccctgcaaagttgaaaatatrgttataactttagagtaggccctatgtatctgtggttctgcctctgtggatttaaccaaccctggatcatttggtactgtaatgcatatttatggaaaaa

SEQ ID NO: 120032 - DNA, 201 bp, Bos taurus; identical to SEQ ID NO: 38958

SEQ ID NO: 120033 - DNA, 201 bp, Bos taurus
caatgttggaaagaagaaaagaggcacacaagtttgtattctactgggctaaagatacttaaaaaatcaatgaacatactcagtagataatgttatatgtsaggagtttgtgagtgatagtgtatgtgtgtgtgtttaaagattaaaatgtgaaaaaagaagactatgttaaaggggatcagaactggcctggaaggcgaa

SEQ ID NO: 120034 - DNA, 201 bp, Bos taurus
ttgtttgtttttaaaagcacaacatagagatatgatatgagttttaaaaaatgtcctttatgaactaagctataccagtctaataacatcagttttctagmattagatagtctattttgaataatagtgagtatggattgttttttctctttactaagaataattctaaagtgtgtcatctgttcagtcatgtccaactat

SEQ ID NO: 120035 - DNA, 201 bp, Bos taurus; identical to SEQ ID NO: 38959

SEQ ID NO: 120036 - DNA, 201 bp, Bos taurus; identical to SEQ ID NO: 38960

SEQ ID NO: 120037 - DNA, 201 bp, Bos taurus; identical to SEQ ID NO: 38961

SEQ ID NO: 120038 - DNA, 201 bp, Bos taurus; identical to SEQ ID NO: 38962

SEQ ID NO: 120039 - DNA, 201 bp, Bos taurus
gagtcatgacctgtctttcttaaataatgaaactgaaagttggagatatttaaaacattttgcaagatttatgagtggctaagccaaggccagacaactcmctgttgtcattgtgtacatagtttttcagtaaagtatatttctactttttttctcattatagctggatgaaggcctcactatgacacctctttactgttt

SEQ ID NO: 120040 - DNA, 201 bp, Bos taurus; identical to SEQ ID NO: 38964

SEQ ID NO: 120041 - DNA, 201 bp, Bos taurus
ttgttttatgaaactaattttttttggcctgtccaattcatttatttctgaaagatcacatattttaaaagacttcttgcagttctagataaatggagcayctggccacctatgactgtccccatcgttctcaacttatatgaataattagaaagcagttgtactctttgaatcttacaataattaataatttgcctgaat

SEQ ID NO: 120042 - DNA, 201 bp, Bos taurus; identical to SEQ ID NO: 38965

SEQ ID NO: 120043 - DNA, 201 bp, Bos taurus
ctcactatactctagttacagtcactcaacttgtgttcctggatcagggtttgtttgtattaacctgtatctgcatgaaacattccagaatcttcacaagygtggctgtttttctgcacttgatctcaactcatatgttcataagagagccttctcctgacgcccattgtaaaaaaggtacctccactcaggctccccatt

SEQ ID NO: 120044 - DNA, 201 bp, Bos taurus
aatattaatttaaaggtaaatttaaatagtgacttcaacaatatctgtaaatgtgaagagcaaagagcaaactttattccagtctcatctctaatatgtayttacttttgtcttaattgattgatggcagagcaaatcatcccttcttatagatttagaataaaatggtatacgtttattttgctaattcacctgttagat

SEQ ID NO: 120045 - DNA, 201 bp, Bos taurus
atacaaggtgaaataaattttgatcaaattaatccaaaaatattactaaacactaaatttagaaatataattaaggtttataattcactctttctccctcmtttccttcctctttgcttcctatttgtatgaatttatcaaacaaagttgacctaagtaagaaagaatgattcaatattaaaatattttaagtgattttgt

SEQ ID NO: 120046 - DNA, 201 bp, Bos taurus
ttttttatcatttttcattccaatatgctatcatattttttaatttttaatgtttttgtagaatttattatcattatgaatttttagcacattttttttargacactgttttgtgcactttgcagtccacctgaaatatcacaacattgttaatgagttataatccaatatagaataaaaagcttaaaaaaatagttctgt

SEQ ID NO: 120047 - DNA, 201 bp, Bos taurus; identical to SEQ ID NO: 79193

SEQ ID NO: 120048 - DNA, 201 bp, Bos taurus; identical to SEQ ID NO: 79196

SEQ ID NO: 120049 - DNA, 201 bp, Bos taurus; identical to SEQ ID NO: 38982

SEQ ID NO: 120050 - DNA, 201 bp, Bos taurus; identical to SEQ ID NO: 38984

SEQ ID NO: 120051 - DNA, 201 bp, Bos taurus
atgcactgtcttatttaaaaatcttgccatttggcacctaagctctcagacagaattcccacccaattgtaagcaggaaggatgccaacttaacagatgarcagaaagtgccaaggccaagagtccaggttcacatatcaaatgtgcttacttagggcaggattcccaggtataagtcttcaaccatgttcagaaaaactg

SEQ ID NO: 120052 - DNA, 201 bp, Bos taurus; identical to SEQ ID NO: 79202

SEQ ID NO: 120053 - DNA, 201 bp, Bos taurus
gtgctgctctgtgaagattagaccagactggacacagtgaaagcaggagaatagttaggaagctaatggaagatatgagagagagattattcaaggccccytccctccagtacattagcctgagcaacttgaaggattaaatatggagtgagtggaagtcgctcagtcgtgtctgactctttgctaccccatggaattctc

SEQ ID NO: 120054 - DNA, 201 bp, Bos taurus
ctggagctttgccttttctgaagctgatatttctagtctgaaaacaaagcatttgagctttgggagaaattcaaaggttatatgaagctcacacaagtctratgctagaatcttctctatcatccttctgccaaatataagccagccagtgttagagggaacataatacagggaatttcattttccatgagggaaacttga

SEQ ID NO: 120055 - DNA, 201 bp, Bos taurus; identical to SEQ ID NO: 38989

SEQ ID NO: 120056 - DNA, 201 bp, Bos taurus
gagtactggagtgggtagcctttcctttttacagggagtatttaaataggcagccacctagtttaggtttagcatgtgggttttggattaattttatggamtatggttcaaatggccgtaaatgttctgtgtctttgtgatattattttggtctgcttagctcatctgaagtccctgggtccccagaattcccaaatagtc

SEQ ID NO: 120057 - DNA, 201 bp, Bos taurus; identical to SEQ ID NO: 38993

SEQ ID NO: 120058 - DNA, 201 bp, Bos taurus
ttgtggctgtttggatttgatgaagaataagtttactttgcattgattttaagatgtgatattttcaaatttgactaggagctgtgaagaaaatatctttkggggcattttctttcagatttcacagtccactggtagtgaaatgcagttatttaccttgatacatattggaaaccataagagattttatgtttatttcac

SEQ ID NO: 120059 - DNA, 201 bp, Bos taurus; identical to SEQ ID NO: 79206

SEQ ID NO: 120060 - DNA, 201 bp, Bos taurus; identical to SEQ ID NO: 38995

SEQ ID NO: 120061 - DNA, 201 bp, Bos taurus
aaaagaatgaaacttcttttctcctttccactgtccacatatttattcatatatatgttagatgatttgattctttctttccactttcttagtcagcacarcttatctcctgtccattacatcaaatactcagctctacgatgtcactgttaaacttattttggaaaaatgcctaaaccctttagttgaaatattccacat

SEQ ID NO: 120062 - DNA, 201 bp, Bos taurus; identical to SEQ ID NO: 38996

SEQ ID NO: 120063 - DNA, 201 bp, Bos taurus; identical to SEQ ID NO: 79210

SEQ ID NO: 120064 - DNA, 201 bp, Bos taurus; identical to SEQ ID NO: 79211

SEQ ID NO: 120065 - DNA, 201 bp, Bos taurus; identical to SEQ ID NO: 38997

SEQ ID NO: 120066 - DNA, 201 bp, Bos taurus; identical to SEQ ID NO: 38998

SEQ ID NO: 120067 - DNA, 201 bp, Bos taurus; identical to SEQ ID NO: 38999

SEQ ID NO: 120068 - DNA, 201 bp, Bos taurus; identical to SEQ ID NO: 39000

SEQ ID NO: 120069 - DNA, 201 bp, Bos taurus
gattcctgaataatattttgatcctgtgggaggcaaagtcacttacactcccagtgcaatgatgttctgtttttgttgtttctattccctctacttttcckttgttggttcctttatttattttgaaagttcaaaaatcctgacacctgaaaagttcatctttacttttggtccattgcatgaaagcagtaaagacacaga

SEQ ID NO: 120070 - DNA, 201 bp, Bos taurus; identical to SEQ ID NO: 39001

SEQ ID NO: 120071 - DNA, 201 bp, Bos taurus; identical to SEQ ID NO: 39002

SEQ ID NO: 120072 - DNA, 201 bp, Bos taurus
taccatcattcttcagtgtaataataaatatcctgaaaagttcaggtcccacttagctactaaagtccagaagatgaccagtcctctagggattgtcatgkggtggattgtgtccccactatttcaccccaccccccaaattcatatgtacttattcccagtactgcagaataagacagtttgggacataaagtcatgaaa

SEQ ID NO: 120073 - DNA, 201 bp, Bos taurus
catatctttgctattgggaatagtgctgttatgaatataagggtgtgtatatcattttgaattacagctttgtccagatatatgtccaggaatgagattamcggataatatggtaactctaatttcagtttttggagacatcttcatactgttctccatagtgggtgccctttttttctttttccctattggacacaggta

SEQ ID NO: 120074 - DNA, 201 bp, Bos taurus; identical to SEQ ID NO: 39005

SEQ ID NO: 120075 - DNA, 201 bp, Bos taurus
tgtgtgcattctggtattaacattctggagtctccctctgtcacttcttaggggacagggtttgatgttttagtccagacagctttgaccattgggtcacrgggccccttgaaaggaagtacttaacttttcaacaatggtaacaagaatgatattcttagaaatctgctgatttaaaatgcttcgccttctcagtccagt

SEQ ID NO: 120076 - DNA, 201 bp, Bos taurus; identical to SEQ ID NO: 39006

SEQ ID NO: 120077 - DNA, 201 bp, Bos taurus; identical to SEQ ID NO: 39007

SEQ ID NO: 120078 - DNA, 201 bp, Bos taurus
tttgctctctggccctttccagaacacatttgtctcctctgctctagggcataacagcttccactgtttgtctgcattctgagtcgtgtgttcattctcaratctcttaatggccattgctgtcactactgtaatcgcataattttaattataaattataataaactgatgaagtaagagatcaaaaggagtattgttgtg

SEQ ID NO: 120079 - DNA, 201 bp, Bos taurus; identical to SEQ ID NO: 39010

SEQ ID NO: 120080 - DNA, 201 bp, Bos taurus; identical to SEQ ID NO: 39011

SEQ ID NO: 120081 - DNA, 201 bp, Bos taurus; identical to SEQ ID NO: 39013

SEQ ID NO: 120082 - DNA, 201 bp, Bos taurus; identical to SEQ ID NO: 39016

SEQ ID NO: 120083 - DNA, 201 bp, Bos taurus; identical to SEQ ID NO: 39021

SEQ ID NO: 120084 - DNA, 201 bp, Bos taurus; identical to SEQ ID NO: 39022

SEQ ID NO: 120085 - DNA, 201 bp, Bos taurus
aggcccaaagagattaatgaatattttttaaacagtaaacaagatagataaaactcttttaaaaaagatagacagaaaaaggacaggaattatcctgcatytgactcaggcctgaaaatcaaaggagattcaagactgaggcagacttgaccacaaatctcctgttcaaagatatcctagagatcaactttagccccgagc

SEQ ID NO: 120086 - DNA, 201 bp, Bos taurus; identical to SEQ ID NO: 79230

SEQ ID NO: 120087 - DNA, 201 bp, Bos taurus
tgaactgcagtgcactgcatattgaatggaattcagtagagtgtaaacataaccattatatgcgctaggaaagcaaagcatcggtgtgactttctttaccrcagtgtttgctgccttgtgatggtctgaaaccaaacccacaatatctccaaagatatacctatttttaggaaaaaatttgcaaaaaatatgtataattat

SEQ ID NO: 120088 - DNA, 201 bp, Bos taurus; identical to SEQ ID NO: 39023

SEQ ID NO: 120089 - DNA, 201 bp, Bos taurus
taatccttctgccaaaactaccatccttgaacttacaggaggccttagacaccatcgtgatatccacacagcattgcttctgatccaggaactcacttcgmagcaaatgaagcatggccatgggcccgtgctcgtggaagtcactcaacttaccatgttctgcatcatcctgaagaggctagattgatagaatggtagaat

SEQ ID NO: 120090 - DNA, 201 bp, Bos taurus; identical to SEQ ID NO: 79235

SEQ ID NO: 120091 - DNA, 201 bp, Bos taurus; identical to SEQ ID NO: 39027

SEQ ID NO: 120092 - DNA, 201 bp, Bos taurus; identical to SEQ ID NO: 39032

SEQ ID NO: 120093 - DNA, 201 bp, Bos taurus; identical to SEQ ID NO: 79241

SEQ ID NO: 120094 - DNA, 201 bp, Bos taurus
ggtgatactagctagctcgtggaacagcaagtggaagttcagacaaggcctctactttttttttttttttttttaagaaatatcttctatttgaggaattyggagggtctaggctactagcaggcctaaactgaaaactaatcatacaagacaaaaactaatgaagaacgtacaccattaagggggaaaaaacctcccagc

SEQ ID NO: 120095 - DNA, 201 bp, Bos taurus; identical to SEQ ID NO: 39034

SEQ ID NO: 120096 - DNA, 201 bp, Bos taurus; identical to SEQ ID NO: 39035

SEQ ID NO: 120097 - DNA, 201 bp, Bos taurus; identical to SEQ ID NO: 39036

SEQ ID NO: 120098 - DNA, 201 bp, Bos taurus; identical to SEQ ID NO: 39038

SEQ ID NO: 120099 - DNA, 201 bp, Bos taurus; identical to SEQ ID NO: 39039

SEQ ID NO: 120100 - DNA, 201 bp, Bos taurus; identical to SEQ ID NO: 39040

SEQ ID NO: 120101 - DNA, 201 bp, Bos taurus; identical to SEQ ID NO: 39041

SEQ ID NO: 120102 - DNA, 201 bp, Bos taurus
tcttagatggcaccactgaaagcaattcagtcagccacttggtgctgtgtccttgtctctaagttagagataaaggcactgtcttcaaacaggttaagagygatgatgatgaagtgtttcattcttggtaggagtttgagcaatgccgtcttcttttgaaacttcctacttaattccaaactacttcataaaataatagtc

SEQ ID NO: 120103 - DNA, 201 bp, Bos taurus; identical to SEQ ID NO: 39046

SEQ ID NO: 120104 - DNA, 201 bp, Bos taurus; identical to SEQ ID NO: 39047

SEQ ID NO: 120105 - DNA, 201 bp, Bos taurus; identical to SEQ ID NO: 39048

SEQ ID NO: 120106 - DNA, 201 bp, Bos taurus; identical to SEQ ID NO: 79254

SEQ ID NO: 120107 - DNA, 201 bp, Bos taurus; identical to SEQ ID NO: 79255

SEQ ID NO: 120108 - DNA, 201 bp, Bos taurus; identical to SEQ ID NO: 79256

SEQ ID NO: 120109 - DNA, 201 bp, Bos taurus; identical to SEQ ID NO: 39051

SEQ ID NO: 120110 - DNA, 201 bp, Bos taurus; identical to SEQ ID NO: 39052

SEQ ID NO: 120111 - DNA, 201 bp, Bos taurus; identical to SEQ ID NO: 39053

SEQ ID NO: 120112 - DNA, 201 bp, Bos taurus
ataaaattgaaaactaccaacctataaaagttgttaatatagtaaatgtaactgtagttttgagagccatcttcacatttaaattagaaaggatctttccrgggcaggggcgggaaaggggtggcggatattcctatctgtcttaagatttaaaattctgttggcatcaagcacagattctgagctcatgatttctctctg

SEQ ID NO: 120113 - DNA, 201 bp, Bos taurus; identical to SEQ ID NO: 39054

SEQ ID NO: 120114 - DNA, 201 bp, Bos taurus; identical to SEQ ID NO: 39055

SEQ ID NO: 120115 - DNA, 201 bp, Bos taurus
cattccactgaggggggcccgttgccccatgggggtccagggtgtgaccccagttcaaagggtgcctcctttggatggagatctggtggtgtgtgatgctyaagaaggaaacggccttgaattcattgcatccaggtccacacacacagagtaaccctggacctgtgctacttcccagctcctggatcactgctcttgaaa

SEQ ID NO: 120116 - DNA, 201 bp, Bos taurus; identical to SEQ ID NO: 39056

SEQ ID NO: 120117 - DNA, 201 bp, Bos taurus; identical to SEQ ID NO: 39057

SEQ ID NO: 120118 - DNA, 201 bp, Bos taurus
aagtgaaaacccttggccaaccaacgtccaacatgttcaaagctaaaacaatatagatttttccagagaggtgctggtggtatctatattagcgaaggagrtgctaggaactggtccctggcccccaatacctctttatacaaagtacctacttgaccaaaggagtcagcttttcttcgttggctttatagattacaaggg

SEQ ID NO: 120119 - DNA, 201 bp, Bos taurus; identical to SEQ ID NO: 79268

SEQ ID NO: 120120 - DNA, 201 bp, Bos taurus
atccaggaaaccagctcaacggcaacttgttggtgcagttgccctgccatcggtgagcccaccgtgagccctgtctggccaggcagtagtggcattcctckctgtagtcctgacacacatcaccatccccagcagtctcacatgtgggccagcagcagttcagtctctccagcctttgctcttcgttacatgggtattctt

SEQ ID NO: 120121 - DNA, 201 bp, Bos taurus
atttccttagggcttccagaataaagtgctacagacccaggattgtctcacagtcctgggggtcgagacatttgagatcaaggtgttagcaggcccgtgcyctctcggaaagcagtaggggaggatctgtttcagtccccctcctggttcctgggctgaggcaggagaactctagtgttcacacggctgtctcactgtgtg

SEQ ID NO: 120122 - DNA, 201 bp, Bos taurus; identical to SEQ ID NO: 39062

SEQ ID NO: 120123 - DNA, 201 bp, Bos taurus
aaaaaagagtgaacgtgagaaaccctggcccttgccctgccaatgaagcacaaccccaggtggtcatctctctctctccccacctgcaccccgccccccaycatgtgggcccaggcacaccctgtgcccaacaggtcctggaagtaataaaacttgctttttcaaagtttcctgacagtggttgctgaggtatgtcttgca

SEQ ID NO: 120124 - DNA, 201 bp, Bos taurus; identical to SEQ ID NO: 39066

SEQ ID NO: 120125 - DNA, 201 bp, Bos taurus; identical to SEQ ID NO: 39068

SEQ ID NO: 120126 - DNA, 201 bp, Bos taurus; identical to SEQ ID NO: 79275

SEQ ID NO: 120127 - DNA, 201 bp, Bos taurus; identical to SEQ ID NO: 39069

SEQ ID NO: 120128 - DNA, 201 bp, Bos taurus; identical to SEQ ID NO: 39070

SEQ ID NO: 120129 - DNA, 201 bp, Bos taurus
ctatgatgtcgatagtgtggggcaatcagtacaaggctgagaacttaacttatatgttaaataaacatacctaataataaacatattccatagatttaatkagcaatgcattattgcacctgctttgagcccttcacatgctttcaaattaaagattgcattcctgggaagtgaagtgagaaacgtacagcttgggattat

SEQ ID NO: 120130 - DNA, 201 bp, Bos taurus
agtccccattactaaatgcatgataacaaccacatccatgcaaagcatgtcttcagactccccaggtcggtcttctagttggtccctcacttgagcctgaytggaattttatctggagtatggtatctcttgtggctcagctggtaaagaaaccgcctacaatgcaggagacctgggttcaatccctgggttgggaagatc

SEQ ID NO: 120131 - DNA, 201 bp, Bos taurus; identical to SEQ ID NO: 39071

SEQ ID NO: 120132 - DNA, 201 bp, Bos taurus; identical to SEQ ID NO: 39072

SEQ ID NO: 120133 - DNA, 201 bp, Bos taurus
agatgcagtggtttatttgcaaacatttacatgagggtttttctatttgactgaaagagaaggagggtagttggggccattagtgtatggaggggtgggarggatggagattaggatggaaattggaacagccaggaagcatctgggtcctactcagccaacattgtgttggtcagagaggaagatgtgggcagagggcag

SEQ ID NO: 120134 - DNA, 201 bp, Bos taurus; identical to SEQ ID NO: 79278

SEQ ID NO: 120135 - DNA, 201 bp, Bos taurus
gctctgatttccatcctgctctccctcacctccatctgcttgggaggcctgttgcccatctgagaactgggaacatctttattgtgcagcagaggctcacygtggtggggggctgtgtggggccatctcacagcctgagtgaccatctctgagccagcggtgtaggcatggctgagccaatggaaatcggctaggggtctc

SEQ ID NO: 120136 - DNA, 201 bp, Bos taurus; identical to SEQ ID NO: 79279

SEQ ID NO: 120137 - DNA, 201 bp, Bos taurus; identical to SEQ ID NO: 79281

SEQ ID NO: 120138 - DNA, 201 bp, Bos taurus; identical to SEQ ID NO: 79283

SEQ ID NO: 120139 - DNA, 201 bp, Bos taurus
cacaaagagttgggcacaactgagcgactttccctccctccctcacagagggggacagtggctcatttggggagcatgtcattaaactgcctgaagcgtgyaaaggccattgccgagagatgatgtcatagctgaaattcttgtttatcttgaacttaaaaactcaacaagaataatctcctgttatttgcctatcatatg

SEQ ID NO: 120140 - DNA, 201 bp, Bos taurus; identical to SEQ ID NO: 79285

SEQ ID NO: 120141 - DNA, 201 bp, Bos taurus
catacataatacttataacagttcataatcaatgaatgatcactggagatgtttcagatacatattccttaatgaactcaggataacatatatccacttcrtacatcctccatctgtaaagactctcctaggaatggaaaactggaaaagtaatttctgtccaaatcttctgaaattagcagatcgatcagaggccttgaa

SEQ ID NO: 120142 - DNA, 201 bp, Bos taurus
gggcacttgcctgacccagcgagtctgcctgcaggtgctgcctttggcttgagtggagtggggaggctggcctgttcccaggttcactgagcctcttcccrctccagaatccggtgtctcctgctagcgtttatcaggtcgggtgatgatgcttcatgagacatctgctcattgactccctggcagatgcggagccccggt

SEQ ID NO: 120143 - DNA, 201 bp, Bos taurus; identical to SEQ ID NO: 39078

SEQ ID NO: 120144 - DNA, 201 bp, Bos taurus; identical to SEQ ID NO: 39079

SEQ ID NO: 120145 - DNA, 201 bp, Bos taurus; identical to SEQ ID NO: 39083

SEQ ID NO: 120146 - DNA, 201 bp, Bos taurus; identical to SEQ ID NO: 39084

SEQ ID NO: 120147 - DNA, 201 bp, Bos taurus; identical to SEQ ID NO: 39085

SEQ ID NO: 120148 - DNA, 201 bp, Bos taurus
acgtgactcgttatagctacatcctttggattggagtgtgttgtgaatttttctctttagagtaatacaggctcatagttctttatgcacagacatgattmaaatgtcttgtaagtacagtttcaaggtgttgccataatttccccaacacacagagaaaccttcaagttcagcggggatttcataaagaaagggtcacta

SEQ ID NO: 120149 - DNA, 201 bp, Bos taurus; identical to SEQ ID NO: 39087

SEQ ID NO: 120150 - DNA, 201 bp, Bos taurus
cacctacagaatcccatggagagaggagctcgcaggcttctctgtccatgggatagcaagggtagggtacaacttagcaactaaaccaagccagttacatkgatgtcagaaacacatacatgtgtattaagtgcgaatctgatgaaggtaaaattgttttatggttggatagtatcaccaactcaatggagatgagtttca

SEQ ID NO: 120151 - DNA, 201 bp, Bos taurus; identical to SEQ ID NO: 39090

SEQ ID NO: 120152 - DNA, 201 bp, Bos taurus; identical to SEQ ID NO: 39091

SEQ ID NO: 120153 - DNA, 201 bp, Bos taurus; identical to SEQ ID NO: 39093

SEQ ID NO: 120154 - DNA, 201 bp, Bos taurus
ttgtaggaagagggcatgtgtccagtactcggagcagccatgacacatgtgcattgctaagtcgctccgtcatggccgattgtttgtgacctatggattakagcccgccaggctcctctatccatgggattctcgcatatctaactgatacacaggccatttcttgtgttgtcctgccccaaaccatgccttttccacctc

SEQ ID NO: 120155 - DNA, 201 bp, Bos taurus; identical to SEQ ID NO: 39095

SEQ ID NO: 120156 - DNA, 201 bp, Bos taurus; identical to SEQ ID NO: 39097

SEQ ID NO: 120157 - DNA, 201 bp, Bos taurus
taaatatacccatgtctattaatgacattaactgtaaattcatagaaactggctgatattgcatttatatcatacagaatcagtagttgaagtatttatawaagaaaattgattagctccggtgactatttactcccaagttttgtcacatgcaggggcttccctggtagctcagttggtaaagaatccactgcaatgcag

SEQ ID NO: 120158 - DNA, 201 bp, Bos taurus
tggggtcacaagagtcggacacgactgagcgacgaaaccaccaccagtccttccaactggggcagtgcagctggcgaggggccggaataggaagagggcayctaaacataccatttcaggtcgtcctgggtttcccattcaggctgggaacacactgctgagggccccagcgagcaggtataattattccagctcacagca

SEQ ID NO: 120159 - DNA, 201 bp, Bos taurus; identical to SEQ ID NO: 39105

SEQ ID NO: 120160 - DNA, 201 bp, Bos taurus; identical to SEQ ID NO: 39107

SEQ ID NO: 120161 - DNA, 201 bp, Bos taurus
ctggtttactggccccttggttcatgggatctcagctcccagaccagggatcaaacccacgccccctgcatcagacagattcttaaccactggacgaccamagaaatgcctgcatggccctcattcttcatgtgtaaggcttagtttgtttttcattcagcctttaactctagttctccaaattgtagtcctcaggaagct

SEQ ID NO: 120162 - DNA, 201 bp, Bos taurus; identical to SEQ ID NO: 39109

SEQ ID NO: 120163 - DNA, 201 bp, Bos taurus
ttcccctccttccatcactgaacacaattcagctggctactaatgtgaaagcatgttgactgaaggctgaacacaagcctgggttttgcttggagggtgcrgagcacacagggtaggactcagaaaacccagcgtgcttgttgggaaaggtcttcacctccattatgcacgcacatgacaaacaaatctctggtctctgca

SEQ ID NO: 120164 - DNA, 201 bp, Bos taurus; identical to SEQ ID NO: 39111

SEQ ID NO: 120165 - DNA, 201 bp, Bos taurus; identical to SEQ ID NO: 39113

SEQ ID NO: 120166 - DNA, 201 bp, Bos taurus; identical to SEQ ID NO: 39114

SEQ ID NO: 120167 - DNA, 201 bp, Bos taurus
tcatactcagtgaatcactttaacttccacaaagtctgccttactttatggacaggatctcagggtacagattatagaattagaaaaaagtcagatttgtrgcttccatgctcactacagagtttctctttcatctttaaacttacatctggacaataatccctatactcaatgatctaggtgttctctagtgaagatttt

SEQ ID NO: 120168 - DNA, 201 bp, Bos taurus
cgaataaactccatgtgttactgaagcctttctgtggccccaacgtgaagccaaggggaaacagtctctgagtgtctctggggcatctggtcacaacatgkggaccgaggaggccgcaggaagcaaggatgaaagactgagagcaatttcaaattccaagagaaatcctttggctaagaataatgtaccttccgtgtcttt

SEQ ID NO: 120169 - DNA, 201 bp, Bos taurus; identical to SEQ ID NO: 39119

SEQ ID NO: 120170 - DNA, 201 bp, Bos taurus
aaaatctagggtctcatgatggcttgaatcctaaaatatttccattctaatatttgaaagtgtcaagaaaaaaataaccagtgtgcttcagtgaaatgaamgtcagtgtagatcttttccccatggtcttacagtacaattcagtggtgaatccacatgtgaagcctctttcccaccctgactccagggccagcagatcac

SEQ ID NO: 120171 - DNA, 201 bp, Bos taurus; identical to SEQ ID NO: 39121

SEQ ID NO: 120172 - DNA, 201 bp, Bos taurus
cgtggaccctcttttgctaaagcaccagctttgccacgtgcttttcaaagcctttaagacttctcagagtgctaccctgcccccttcctcaagattccgcrgaggccgcaggaccccccgtgccggcccctcatcacacctgggccggcaggtgacccgccctgtctgggctctgacgaccccggggcgtccaccgccctt

SEQ ID NO: 120173 - DNA, 201 bp, Bos taurus; identical to SEQ ID NO: 39123

SEQ ID NO: 120174 - DNA, 201 bp, Bos taurus
agtccatggggctgcaaagagtcggatacaactgagcagctgaactgaactgaactgaggatgcttgggacagcgacgtctgaggtcccactcactggacmcagagttgagggcctccaaagagaggctcacagggcaggggcgccaccccagacacctgaaggaatgcaggaggcaggagaggtgggggagtcaggaacg

SEQ ID NO: 120175 - DNA, 201 bp, Bos taurus; identical to SEQ ID NO: 39125

SEQ ID NO: 120176 - DNA, 201 bp, Bos taurus
ccaagacagaaagctgtttgcctcctgcagcaccagcctgccctttctgcacatatcctggtcactgtgtgcttgtggccccctccctgcagccccacagygccagccatgcttcctaccatcctgggagtgtgtactgggagcgtgttcacaggccagggctatgagctccctcaaactactggaggactgggaaggtgg

SEQ ID NO: 120177 - DNA, 201 bp, Bos taurus
actggagtgggtagcctttcctttctccagtggatcttcccgaccaaggaatcgaactgaggtctcatgcattgcaggcggattctttaacaactgagctrtgagggaagggccatcttcctgtgtgactgccctattctgcatccccgccaacaggcagtgatgccgtagaaataatttctcacggaaccagtggcagcc

SEQ ID NO: 120178 - DNA, 201 bp, Bos taurus
ctttggatgctgcttctcttgaagccaggaatagccctttgaacgttctgccaatttagacaaattctaacagctaaagaggccatagtcaaggtcattcrgtcgtgtccaactctttgcgaccccatggactgtatagtccatggaattctccaggccagaatactgcagtgggtagcctttcccttctccaggggctct

SEQ ID NO: 120179 - DNA, 201 bp, Bos taurus; identical to SEQ ID NO: 39129

SEQ ID NO: 120180 - DNA, 201 bp, Bos taurus; identical to SEQ ID NO: 39130

SEQ ID NO: 120181 - DNA, 201 bp, Bos taurus
agcagagaaggctagcgggacagccacgccggccacaaacgcggcattcagcagcgcagggtcccgccgccgattataattaccgccgacaacagtcaacrtcagggctgcctctacttattggccgcaatcaatgatcatctgtgggcgacacattgaaaattcatcttacaaaccagcaccctgattgggttatttgct

SEQ ID NO: 120182 - DNA, 201 bp, Bos taurus
tcagggactcttccccttgccctggaacacacctcgtcaccagtttgaggaatggttcttcctataatgaatatgtttatcaacccaggcctcagagtgcrgggcggtgattgagtgcagaccggagcgtgacacgctatgagagcaggaataaccttcacgacacgagtaccacaggctcacaaagccccggtgctgcct

SEQ ID NO: 120183 - DNA, 201 bp, Bos taurus
ggaaatggccggcgtctccataaatgagtgacttgatgagattcatcgtgaagattctgcttctaaaagggacgcatttgtgaaaattgctggaaacaacmcaggcctgagagaatctagttgaagcctttaaaggcatgggtgcccgtggaccccctccccctggtgccagccccgcgaggtgaaggtccagagggaatg

SEQ ID NO: 120184 - DNA, 201 bp, Bos taurus
caatctcactcttttattttatagcatttacaaagtagttaacctctctctgtttacattttctcactttataaaacaagaaccttttataaaataagacrcatgggccaccccacatcccaaggtcactgtggtctggggctctctcataaaacactgtgaaaagaggaaaacaccgaatactgtagagtattgatgctt

SEQ ID NO: 120185 - DNA, 201 bp, Bos taurus; identical to SEQ ID NO: 39133

SEQ ID NO: 120186 - DNA, 201 bp, Bos taurus; identical to SEQ ID NO: 39134

SEQ ID NO: 120187 - DNA, 201 bp, Bos taurus; identical to SEQ ID NO: 39135

SEQ ID NO: 120188 - DNA, 201 bp, Bos taurus; identical to SEQ ID NO: 39136

SEQ ID NO: 120189 - DNA, 201 bp, Bos taurus; identical to SEQ ID NO: 39137

SEQ ID NO: 120190 - DNA, 201 bp, Bos taurus; identical to SEQ ID NO: 39143

SEQ ID NO: 120191 - DNA, 201 bp, Bos taurus; identical to SEQ ID NO: 39145

SEQ ID NO: 120192 - DNA, 201 bp, Bos taurus; identical to SEQ ID NO: 39146

SEQ ID NO: 120193 - DNA, 201 bp, Bos taurus; identical to SEQ ID NO: 79366

SEQ ID NO: 120194 - DNA, 201 bp, Bos taurus; identical to SEQ ID NO: 79368

SEQ ID NO: 120195 - DNA, 201 bp, Bos taurus
atgtggcggtgctatagcagctagctcagggagcattctggagcccagaagcagaacctccacagtgtctctccagcatccccgatgacaaaacttactgycagttggccaaggaatcatttatagggcccagctccactttcatggatcaggcaatggagaaattcagaactgagaggcaatacattgataattggcaca

SEQ ID NO: 120196 - DNA, 201 bp, Bos taurus
taaaagtttttgaaaatcattcaaggttgaaaatttattggtatgaatctgtgttagttggggagtaatacattgtctattaacaacaaatcctgagtaayggtaaggtgtagaggtttgaatctttttaggggcaatgattaatccagagtcttttaagtattgttgagctatgtcaaacatttgttgagtttctaaaac

SEQ ID NO: 120197 - DNA, 201 bp, Bos taurus
taaaagtaagactcccaaaagtagagtataaaaagaaacaaagtatttttttttaatctggagtttatttaaaaaataagtttttttttgaaaggtaaaayatggtgtaaaaaataaaaggtaaaggggtaataaagaaccatgttaaggcaccatgaaggaaaaaagaaaaagaagagagtaaagaaagaaaaaaaaaag

SEQ ID NO: 120198 - DNA, 201 bp, Bos taurus; identical to SEQ ID NO: 79370

SEQ ID NO: 120199 - DNA, 201 bp, Bos taurus
ccttatcagtcatctgagaaacacaagttttgaacactgaactctagtgttttgtttttccattagatttgcagagattgaactctccacagcagggatgrgggagcaggcatggggcacagcattattgtggacaggcataatctatgctaattgcttgattcatctcgagctgtccttgatgcatttcatgatgacttt

SEQ ID NO: 120200 - DNA, 201 bp, Bos taurus
tgttcctaaaaggaatgataagggtctatgatgagggctttatcccatggccttttgtaacctgaaccacttccttaaaggccccatctgcttcagttcakttcaattcagtcactcagttgtgtccgactctttgtgaccccatgaatcgcagcacgccaggcctccctgtccatcaccaactcctggagttcactcaga

SEQ ID NO: 120201 - DNA, 201 bp, Bos taurus; identical to SEQ ID NO: 79371

SEQ ID NO: 120202 - DNA, 201 bp, Bos taurus
accagctacaatcagggagcacgcctgcaggaagcagacgctgcaggcagagggtgtgggggcagccaggctcacagggtgagggccccccactggggccrcggggcaggagcccacctggaacagatgatttcatctgatgactgcacgctgggcagctcccccaggtggttgtctgagaggttcagcttccggaggttg

SEQ ID NO: 120203 - DNA, 201 bp, Bos taurus
gagcacaccgagcttgattctggccaaccctcatccctgtgcccactccccccagttggctccttaggctccgtggatgcctttcccccagcagggctgakgaacggccagctagatttcacccccagctccgtctgaaattcctaccactgtacaccaaacagaacaccccaggtcccaggggcccgtgaggctggctga

SEQ ID NO: 120204 - DNA, 201 bp, Bos taurus; identical to SEQ ID NO: 79372

SEQ ID NO: 120205 - DNA, 201 bp, Bos taurus
cccctgcaccacccctgcctctaggaggccccacccagcccggcttcctgccgccttgtgtgcctggaggggggcgcgagggccgggaggcctcttctttmggtctcggttctcgcattcccagagtgagtggctttcatgtcacctaggcttgtggggaggaagcaggtgtgacccagggagagatctgagcccatgatc

SEQ ID NO: 120206 - DNA, 201 bp, Bos taurus; identical to SEQ ID NO: 79373

SEQ ID NO: 120207 - DNA, 201 bp, Bos taurus; identical to SEQ ID NO: 79374

SEQ ID NO: 120208 - DNA, 201 bp, Bos taurus; identical to SEQ ID NO: 79375

SEQ ID NO: 120209 - DNA, 201 bp, Bos taurus
ggggaaaccaaattagaaaattattgcagacaattcagtgagacaaatactatatatagcctgagggagcacttggccaaggcccttaatcctgacttggrtatgtggtaggctccccaagactggaggtttcctccttgaaggttgagagtgggaggggaaaggctgagtatgattttagggagaatgggccaagaaaag

SEQ ID NO: 120210 - DNA, 201 bp, Bos taurus
acttaactagtttatatgcactgagaagccaaaaagtccgtgtgattccccttactgtgatacttgatttactgtgataatttggaactgagtccagagtrtctccaaggtctgcctgtgagggatttgtatactgagagtgtaactgtattctgctggtgagtctgtcattaaggcagtctaaaatgttatccttaaaac

SEQ ID NO: 120211 - DNA, 201 bp, Bos taurus
agccaggtgtctccctaaagaccatgaggccgccacctccacggctctcccgagcgtgcatttccacacaggcgaggaagacaggcagcctttgctacacrtctctgaggcctggtgctttgtgttctggggtgctgtcgggttttcagctggccagcctggcttggccccggccccggcgggagaacgcgtgtctgcccg

SEQ ID NO: 120212 - DNA, 201 bp, Bos taurus; identical to SEQ ID NO: 79377

SEQ ID NO: 120213 - DNA, 201 bp, Bos taurus; identical to SEQ ID NO: 79378

SEQ ID NO: 120214 - DNA, 201 bp, Bos taurus; identical to SEQ ID NO: 79379

SEQ ID NO: 120215 - DNA, 201 bp, Bos taurus; identical to SEQ ID NO: 79380

SEQ ID NO: 120216 - DNA, 201 bp, Bos taurus; identical to SEQ ID NO: 79381

SEQ ID NO: 120217 - DNA, 201 bp, Bos taurus; identical to SEQ ID NO: 79382

SEQ ID NO: 120218 - DNA, 201 bp, Bos taurus
agaagtcacaattcggaagagaaactggtattttcataccagtatactaatattctccaagaaaaatcagttatgaaaggaaagactggaggtatacaackagattgtcacccattcttgtggtttaaagaatatttaactcctagatacacatacttatttagatcttttaaagttactttccataatgcagaatatagt

SEQ ID NO: 120219 - DNA, 201 bp, Bos taurus; identical to SEQ ID NO: 79384

SEQ ID NO: 120220 - DNA, 201 bp, Bos taurus
cccgcatcctttattctctaccatatctcttacgagcagtcaggccgtgtttgttcacacgttttaaaatacctggctcccgcacaacactggaaaccccyctccgccgctccaaccccgaggtggacgcagggttggcgtctggcgagtgctcagcaaacacccgcgagaatgtgtagctgcggccggaagacgcaggtc

SEQ ID NO: 120221 - DNA, 201 bp, Bos taurus; identical to SEQ ID NO: 79385

SEQ ID NO: 120222 - DNA, 201 bp, Bos taurus
ctccgctcctgtggactcgcccatcaccccagcgcgcaggccggtcagcaaaaccgcaggcggtaacaggtgctgtgtgccttggccaggtctcttggacsgtgggtcttcaacatgggcagcagcgcccccaactgggagaaatctgatacaggacgaggggtggtggcaagtgatggttaattttgtttcaactcgatt

SEQ ID NO: 120223 - DNA, 201 bp, Bos taurus
aaacctcttgtcagcatcttctcatctctgaagccaggctggagaggcaggtggtgggtggtcaaaagacaggaaggagtagggggcccccctgcctcatragctgatggaatttgcatggagactgtgaacacataagcatccctgtttaccgcaaaaaacattggccagacgccgctgctgctgcttagctgagcagcc

SEQ ID NO: 120224 - DNA, 201 bp, Bos taurus; identical to SEQ ID NO: 79387

SEQ ID NO: 120225 - DNA, 201 bp, Bos taurus; identical to SEQ ID NO: 79388

SEQ ID NO: 120226 - DNA, 201 bp, Bos taurus; identical to SEQ ID NO: 79389

SEQ ID NO: 120227 - DNA, 201 bp, Bos taurus
aatgctgaccacgttgggtggaagggctcaagttcaggggcaaggcgggcctgagcttcctgcagctatatcaggtgaggccccctcttctgttatcattygtgagacatttgagatgctatttcctcctgtctgcccccgtagggctccacatttgtcccccaaagtgacacctctttgaatgcaaagggaacagtctgt

SEQ ID NO: 120228 - DNA, 201 bp, Bos taurus; identical to SEQ ID NO: 79390

SEQ ID NO: 120229 - DNA, 201 bp, Bos taurus; identical to SEQ ID NO: 39154

SEQ ID NO: 120230 - DNA, 201 bp, Bos taurus; identical to SEQ ID NO: 39155

SEQ ID NO: 120231 - DNA, 201 bp, Bos taurus; identical to SEQ ID NO: 39156

SEQ ID NO: 120232 - DNA, 201 bp, Bos taurus; identical to SEQ ID NO: 39157

SEQ ID NO: 120233 - DNA, 201 bp, Bos taurus; identical to SEQ ID NO: 39158

SEQ ID NO: 120234 - DNA, 201 bp, Bos taurus; identical to SEQ ID NO: 39159

SEQ ID NO: 120235 - DNA, 201 bp, Bos taurus; identical to SEQ ID NO: 39160

SEQ ID NO: 120236 - DNA, 201 bp, Bos taurus; identical to SEQ ID NO: 39161

SEQ ID NO: 120237 - DNA, 201 bp, Bos taurus; identical to SEQ ID NO: 39162

SEQ ID NO: 120238 - DNA, 201 bp, Bos taurus; identical to SEQ ID NO: 39163

SEQ ID NO: 120239 - DNA, 201 bp, Bos taurus; identical to SEQ ID NO: 39164

SEQ ID NO: 120240 - DNA, 201 bp, Bos taurus; identical to SEQ ID NO: 39165

SEQ ID NO: 120241 - DNA, 201 bp, Bos taurus; identical to SEQ ID NO: 39166

SEQ ID NO: 120242 - DNA, 201 bp, Bos taurus
aaatttcatcttttaaaaaggatcacctgaaggaacacagtgatgtcaatggatattcaaaatgattggccatggaagtggtggtggtacatctagctacmtagataacattcagatacactagtactaacccaaagctagaggatttggttttaaaaacatagtacaaatgataacataattaaggcaatcccactctcc

SEQ ID NO: 120243 - DNA, 201 bp, Bos taurus
gagttggaattctgatgtgctgtgtccataaagctttgataggcactgccttgtatatccagagagcagggtccttctggatggagataagtggatacaargatgctaggcaaagagaacttaaaacagtacaggcactacaaccaagagtttgacaatctcagctatgaccaacggttcttttttttttccttcttcatc

SEQ ID NO: 120244 - DNA, 201 bp, Bos taurus; identical to SEQ ID NO: 39167

SEQ ID NO: 120245 - DNA, 201 bp, Bos taurus; identical to SEQ ID NO: 39168

SEQ ID NO: 120246 - DNA, 201 bp, Bos taurus; identical to SEQ ID NO: 39169

SEQ ID NO: 120247 - DNA, 201 bp, Bos taurus; identical to SEQ ID NO: 39170

SEQ ID NO: 120248 - DNA, 201 bp, Bos taurus; identical to SEQ ID NO: 39171

SEQ ID NO: 120249 - DNA, 201 bp, Bos taurus; identical to SEQ ID NO: 39172

SEQ ID NO: 120250 - DNA, 201 bp, Bos taurus; identical to SEQ ID NO: 39173

SEQ ID NO: 120251 - DNA, 201 bp, Bos taurus; identical to SEQ ID NO: 39174

SEQ ID NO: 120252 - DNA, 201 bp, Bos taurus; identical to SEQ ID NO: 39175

SEQ ID NO: 120253 - DNA, 201 bp, Bos taurus; identical to SEQ ID NO: 39177

SEQ ID NO: 120254 - DNA, 201 bp, Bos taurus; identical to SEQ ID NO: 39178

SEQ ID NO: 120255 - DNA, 201 bp, Bos taurus; identical to SEQ ID NO: 39179

SEQ ID NO: 120256 - DNA, 201 bp, Bos taurus
atcaagaactgattttccaccttttgcagttgaccataaattaaacagatattctggaaaccagaaatcaaatataaaatcttcttggaaatttgacataytcttccaacagaaatagtttaaaatataattttatcccaatgacagatttaatagcaaacaaatcaggagcaggtctcactagttcttacagttcccagg

SEQ ID NO: 120257 - DNA, 201 bp, Bos taurus
tccacacccaatgcaagaccttcatgaagccctactgtgccttactgctttgacaggctccagtcaaatactcctgggcctttctagaggtctaaactttktagaggtgtgtttcttccccagatcagcatctggtactctgtcagaatgccaggctctggccaattctgctttgactggtgtctctcctaacttttgaaa

SEQ ID NO: 120258 - DNA, 201 bp, Bos taurus; identical to SEQ ID NO: 39181

SEQ ID NO: 120259 - DNA, 201 bp, Bos taurus; identical to SEQ ID NO: 39182

SEQ ID NO: 120260 - DNA, 201 bp, Bos taurus; identical to SEQ ID NO: 39183

SEQ ID NO: 120261 - DNA, 201 bp, Bos taurus; identical to SEQ ID NO: 39184

SEQ ID NO: 120262 - DNA, 201 bp, Bos taurus; identical to SEQ ID NO: 39185

SEQ ID NO: 120263 - DNA, 201 bp, Bos taurus; identical to SEQ ID NO: 39186

SEQ ID NO: 120264 - DNA, 201 bp, Bos taurus; identical to SEQ ID NO: 39188

SEQ ID NO: 120265 - DNA, 201 bp, Bos taurus; identical to SEQ ID NO: 39189

SEQ ID NO: 120266 - DNA, 201 bp, Bos taurus
accccaatttaagcaagacccgatggaacatccctgttccatatttcctggttttagtcttctgagcttgaagaagttcagtatggccaacaaattttggktttggtgctttctttcacctgtatactacgaacttttgttcccttctcataatattcattgtcaaataattctgtttggtaatctagtcttaatgacatt

SEQ ID NO: 120267 - DNA, 201 bp, Bos taurus; identical to SEQ ID NO: 39192

SEQ ID NO: 120268 - DNA, 201 bp, Bos taurus
gttcacacctgactctgacctccagccagagatgctatggaaaggatacacatccggtccagcaccaggaggaagatctcgcgagagcaggcaggccacayggggctcctacgggaagaaggcggtgtcctcctccccttgttcctgatcagaaaccaggctagggaactgcagggatggggcagagtcatgactggccaa

SEQ ID NO: 120269 - DNA, 201 bp, Bos taurus; identical to SEQ ID NO: 79423

SEQ ID NO: 120270 - DNA, 201 bp, Bos taurus; identical to SEQ ID NO: 79424

SEQ ID NO: 120271 - DNA, 201 bp, Bos taurus
agcagggcgttaggggtatttgttatggggaagaaggggcaactagtaagactaaaacgtagtgatgctgagacctccagggccctgatcctgttggaacrtgcccacaacttgccaacacagcagccaagacagtctaggacagaagacaaccgagattccctctttgatttccggtagtgctgagttaaggggtcaatt

SEQ ID NO: 120272 - DNA, 201 bp, Bos taurus
tgtccaaggtcagagtcggaatggaacatggagcttttgacttcagtccaaaaggcggccgttggcctgccaccttccatgctatgttggccccaggctargaagggcagggctcagtgtccttcagagccggcgtccctgcccatcagaatgtgtcagggccctcccctccagcttctgaaacatcatttatcattcttg

SEQ ID NO: 120273 - DNA, 201 bp, Bos taurus
ttgatccctggttgcgatcccccatgcaactaaagatccccaggacacagctaaaaaatcccacggctggggatcccacacgctgcaatgaagatcgaggrtcctgaatgcaacagctggggcccaggacagccaaatatataaataaataagtgcttgtttttagaaaaagtcaagtcatcttgacttgagaggcacatg

SEQ ID NO: 120274 - DNA, 201 bp, Bos taurus; identical to SEQ ID NO: 39194

SEQ ID NO: 120275 - DNA, 201 bp, Bos taurus
aataacatttgagttgagcctcaaaagatgtgcaaaatttatccatgccaagttgggaacagttccagaaatagaggcaacatataaaaaccatggcaacygtctgcctttctccacatttacatgcatacctgaggatgtaaatgagataacaatttatacattcatgtgcatgaaggtgtcttaaggatagataacttc

SEQ ID NO: 120276 - DNA, 201 bp, Bos taurus; identical to SEQ ID NO: 39198

SEQ ID NO: 120277 - DNA, 201 bp, Bos taurus
gcacagaagaagctcacacccctggtacactatcctgaattttgtgactgctaccaaggtacacctctatatcacgttgctctgtggccaggggggctttmtgctcatggatcccagaggacataagcaatggagaaagagttcttaaatagtcaccacccgcagggcacagcaagaggcaacagacccagaggcctggtc

SEQ ID NO: 120278 - DNA, 201 bp, Bos taurus; identical to SEQ ID NO: 39200

SEQ ID NO: 120279 - DNA, 201 bp, Bos taurus
tagctaaaaatggggtcttcagacccagtgaaaagtgatccccttgtccttttcaattgcccagtggctttcagagatagaggttaaatgtggccagagcytaaaacatttcttttgaataacttgtgcagtggtaaattttgtcctttaagtctggcttttttgggaaacagcctgaagtcatttagaacaaatctggta

SEQ ID NO: 120280 - DNA, 201 bp, Bos taurus
ctgaagactcaggctattcaggtacttagctctgggttatctgctttcagagaaacatcgacagatgagttgtctgactgtccagttgatactcctgagcrctgcctgaaaccaggcgccccaggcagctccccaggcgattgacttcgggtggggttctggccacccgaacaaggctggcttctttcttgttttacttaa

SEQ ID NO: 120281 - DNA, 201 bp, Bos taurus
ttctaaaaataattattaaacactggttgggaccaaacttttaaaaaactcttgaatatccttgagttagtttccaggcccatgtgaagtattccttgggrgaaaaggaaatttgtccagtgggtctgtagctggtaccacattccatgtttctgtacatgccttgatgtttctttctgctgccactggcctgtctcccca

SEQ ID NO: 120282 - DNA, 201 bp, Bos taurus; identical to SEQ ID NO: 39205

SEQ ID NO: 120283 - DNA, 201 bp, Bos taurus; identical to SEQ ID NO: 39206

SEQ ID NO: 120284 - DNA, 201 bp, Bos taurus
cagtgaagtattcactttagatttgtggatctgaagcatgaaatcgccagcatgtagtttttttttttaaaggcagaccactggcctaaagagcaagagtktggggagaggggaaaacccagttgagcagcctccttcaaggcactgattggggtaaatttcgcactgaagggctaaatcccatcaactcagagcctgcct

SEQ ID NO: 120285 - DNA, 201 bp, Bos taurus; identical to SEQ ID NO: 39209

SEQ ID NO: 120286 - DNA, 201 bp, Bos taurus
gttcttttccttctcagccagagctccagtccctcagcctgggacctcagggggccctgggcttctgtgccctgcaaggccacggttgtgcaagcgctctygggtctcttgttacccaggagccggcaacagaccaaaataaagttgagagggggaccggcggggagggccgagcgagcctctgtagggagtctgaccagg

SEQ ID NO: 120287 - DNA, 201 bp, Bos taurus
tgggaaacattttgggtccaaaatcattcaggaagcaaaggtatgttcgccaagatctggctgtgccaaaaatgaagatggccaggctgccctatgatttrtgcgtgtgcatgttaagtaacttcatttgtgttcatctgtttgcaaccctatggactgtagtccaccaggcccctcttccatgggatactccaggtagaa

SEQ ID NO: 120288 - DNA, 201 bp, Bos taurus; identical to SEQ ID NO: 39210

SEQ ID NO: 120289 - DNA, 201 bp, Bos taurus; identical to SEQ ID NO: 39211

SEQ ID NO: 120290 - DNA, 201 bp, Bos taurus; identical to SEQ ID NO: 79438

SEQ ID NO: 120291 - DNA, 201 bp, Bos taurus
atattggggggccccctggggagaggaagttagcccagagttgggtgtttcggtgattttcgtctgaggtatataatgaaatctatgagctgtaaagctgyatagaaatttccatcctgagcatactgcaaatgacttttgtactttgagaagccgaatcccagttgagtcctgaggttattattctaaggtcatctttcc

SEQ ID NO: 120292 - DNA, 201 bp, Bos taurus; identical to SEQ ID NO: 79440

SEQ ID NO: 120293 - DNA, 201 bp, Bos taurus; identical to SEQ ID NO: 39214

SEQ ID NO: 120294 - DNA, 201 bp, Bos taurus; identical to SEQ ID NO: 79441

SEQ ID NO: 120295 - DNA, 201 bp, Bos taurus; identical to SEQ ID NO: 79442

SEQ ID NO: 120296 - DNA, 201 bp, Bos taurus; identical to SEQ ID NO: 39215

SEQ ID NO: 120297 - DNA, 201 bp, Bos taurus
cagcttcgctgctggttcagtgcactctgcgagagttttgtgatagagaagaataaacctgactccatactgaatctgtttattttactttaaccatcttrtctattgctttcgctgaaagttaagaatgttgcctgtaccctgaaatacaagagagcccattccctaggctctgacctttgagggtataacacttctccg

SEQ ID NO: 120298 - DNA, 201 bp, Bos taurus; identical to SEQ ID NO: 39217

SEQ ID NO: 120299 - DNA, 201 bp, Bos taurus; identical to SEQ ID NO: 39218

SEQ ID NO: 120300 - DNA, 201 bp, Bos taurus; identical to SEQ ID NO: 79448

SEQ ID NO: 120301 - DNA, 201 bp, Bos taurus; identical to SEQ ID NO: 39220

SEQ ID NO: 120302 - DNA, 201 bp, Bos taurus; identical to SEQ ID NO: 39223

SEQ ID NO: 120303 - DNA, 201 bp, Bos taurus; identical to SEQ ID NO: 39224

SEQ ID NO: 120304 - DNA, 201 bp, Bos taurus; identical to SEQ ID NO: 79454

SEQ ID NO: 120305 - DNA, 201 bp, Bos taurus; identical to SEQ ID NO: 39225

SEQ ID NO: 120306 - DNA, 201 bp, Bos taurus
agagaccttggcagctgcaaagggcaacctctctcccattctctgccatagcctggagttccacagtcgagccacacggtcgggttgaagaaggaattcayagggcctggactccatcttaggcctgttcatgctgatcatgctcagccacctttccaatggactctgaactctgtgtttagtgcccatgaaaacaacaac

SEQ ID NO: 120307 - DNA, 201 bp, Bos taurus; identical to SEQ ID NO: 39233

SEQ ID NO: 120308 - DNA, 201 bp, Bos taurus; identical to SEQ ID NO: 39234

SEQ ID NO: 120309 - DNA, 201 bp, Bos taurus; identical to SEQ ID NO: 39237

SEQ ID NO: 120310 - DNA, 201 bp, Bos taurus; identical to SEQ ID NO: 39238

SEQ ID NO: 120311 - DNA, 201 bp, Bos taurus; identical to SEQ ID NO: 39239

SEQ ID NO: 120312 - DNA, 201 bp, Bos taurus; identical to SEQ ID NO: 39240

SEQ ID NO: 120313 - DNA, 201 bp, Bos taurus; identical to SEQ ID NO: 39241

SEQ ID NO: 120314 - DNA, 201 bp, Bos taurus
cagtttatggggtcacaaagagtccaacatgactgactgagcacacacctagctacagatagaagcatggacgtcactgactaaagatgttttgacaccaytgatacggcattcccaggcctgggcaatgctagaactgtgggtaggtgttgctggccacgtgccaggtggaattctgtgtccagtgctggacgacccttt

SEQ ID NO: 120315 - DNA, 201 bp, Bos taurus
acttgattgcgcttccactgccagctccaggagcaaggaggaggtcccagaggcccaacaaaacctgggaaagagcaggagcctgccaaagggccatcatragccaccagctgagtctagcaccgatagggctcataggtcttcagctctatttttcaaagtgaaggtacccctagtgctcccagcaattgcccatcacaa

SEQ ID NO: 120316 - DNA, 201 bp, Bos taurus; identical to SEQ ID NO: 39245

SEQ ID NO: 120317 - DNA, 201 bp, Bos taurus
aaaaaagaatatacttcattaggctctagctgccatagatagtggttcctctaatgagtctgtacaaaagtcaattgaaaaccttctggaaaagattcaayaggccattaagaacatgcatggctcacaggaaaaggtcaaaatatcaacattaaagaagtgggttccaaccctcacgcgtgactttgagagattcaaggc

SEQ ID NO: 120318 - DNA, 201 bp, Bos taurus; identical to SEQ ID NO: 39247

SEQ ID NO: 120319 - DNA, 201 bp, Bos taurus; identical to SEQ ID NO: 39249

SEQ ID NO: 120320 - DNA, 201 bp, Bos taurus; identical to SEQ ID NO: 39250

SEQ ID NO: 120321 - DNA, 201 bp, Bos taurus
ccagtttctctctttgtaaaatggagtttattttgaggactaaaggagaaaaaaaacaatctcttataaattcaaaagctcttggccgagcactggagaaytcagaggactcagtattattagctggatcctaggaaaagcaaagcctgccttacatctgaagcccattacaggggaaaaagcctccctgggtagcgggtg

SEQ ID NO: 120322 - DNA, 201 bp, Bos taurus
atgcgcttgtacacttgagtcagtgtgtgactgtcaaaacctagacaagcacactatctgcgaaaacaaatattctgcctgagcaaaagtttgaaagtacmgtatttttcactctcttctcccctttttcatgacaaaaatctttactcaaaagcccctgctttcttcaccatgctaatgaatgtacagaggcatgtagag

SEQ ID NO: 120323 - DNA, 201 bp, Bos taurus; identical to SEQ ID NO: 39251

SEQ ID NO: 120324 - DNA, 201 bp, Bos taurus; identical to SEQ ID NO: 39253

SEQ ID NO: 120325 - DNA, 201 bp, Bos taurus; identical to SEQ ID NO: 79473

SEQ ID NO: 120326 - DNA, 201 bp, Bos taurus; identical to SEQ ID NO: 79475

SEQ ID NO: 120327 - DNA, 201 bp, Bos taurus
cctgtctgacttgtgtggctaggaatggttgtgtttggcctgcgggcctagggaccatcatgcccagggccagcaggcctggctctccctcccaggggccygcagtgactgctgtgtgttcatgcagcagtctgcaggcacagtgctttctcgtggtcattgtcagagatgtagggtggtcttgttttgcgggtaaggaag

SEQ ID NO: 120328 - DNA, 201 bp, Bos taurus; identical to SEQ ID NO: 39257

SEQ ID NO: 120329 - DNA, 201 bp, Bos taurus
cgaggatcagttcaggacctcatagacactaaggccagagagcggagaggctgaagaatgtgggttctctggacagctgctgagccaactgggcctccagytgtctcctagcgtggtctacagagatggctgcaggtgtgtggcttgagagacagggtcaatgtcccaccacacataaaactagaaagaaaagaaaaatga

SEQ ID NO: 120330 - DNA, 201 bp, Bos taurus; identical to SEQ ID NO: 79478

SEQ ID NO: 120331 - DNA, 201 bp, Bos taurus; identical to SEQ ID NO: 79479

SEQ ID NO: 120332 - DNA, 201 bp, Bos taurus; identical to SEQ ID NO: 79480

SEQ ID NO: 120333 - DNA, 201 bp, Bos taurus; identical to SEQ ID NO: 39261

SEQ ID NO: 120334 - DNA, 201 bp, Bos taurus
tgatgctataaaagatccatttgaagtgcaaagtaagtcagtgggtcttaatgtaacagaggacaaagagttcattgatatggtttcagcatttacattgyaactcatctttaagaaactaacatttgccaagttttggtgtaatatcaaagaaagtttttcaaaactatccaaaaagactttttaaatatccctttattc

SEQ ID NO: 120335 - DNA, 201 bp, Bos taurus; identical to SEQ ID NO: 39265

SEQ ID NO: 120336 - DNA, 201 bp, Bos taurus; identical to SEQ ID NO: 39266

SEQ ID NO: 120337 - DNA, 201 bp, Bos taurus; identical to SEQ ID NO: 39267

SEQ ID NO: 120338 - DNA, 201 bp, Bos taurus
atctcggccacccccatgcagtgcattgtaaggctaaaaacttcaaaaaccggcccgtctcctctgttttccattctgcttttcctctctccccactgatkcgtgggggaacgacctcacctgatttttatgtagaaaattgagtccatctggcaatagctccctcccgccccctccccccaacttgaatgtggtcctggg

SEQ ID NO: 120339 - DNA, 201 bp, Bos taurus; identical to SEQ ID NO: 79489

SEQ ID NO: 120340 - DNA, 201 bp, Bos taurus; identical to SEQ ID NO: 39268

SEQ ID NO: 120341 - DNA, 201 bp, Bos taurus; identical to SEQ ID NO: 39272

SEQ ID NO: 120342 - DNA, 201 bp, Bos taurus; identical to SEQ ID NO: 39273

SEQ ID NO: 120343 - DNA, 201 bp, Bos taurus; identical to SEQ ID NO: 39274

SEQ ID NO: 120344 - DNA, 201 bp, Bos taurus; identical to SEQ ID NO: 39275

SEQ ID NO: 120345 - DNA, 201 bp, Bos taurus; identical to SEQ ID NO: 39278

SEQ ID NO: 120346 - DNA, 201 bp, Bos taurus; identical to SEQ ID NO: 79499

SEQ ID NO: 120347 - DNA, 201 bp, Bos taurus; identical to SEQ ID NO: 79500

SEQ ID NO: 120348 - DNA, 201 bp, Bos taurus; identical to SEQ ID NO: 39279

SEQ ID NO: 120349 - DNA, 201 bp, Bos taurus
ggagtgacttttttcccccagatattttggttttcttaacatttgaaatggatgagaaaaaaattaaaactgatgacttttaattaatgaagcagttgttrtgaaatacattttctccatttaagtttgctaggtgtgtcaggattttatacagataatctaaatacttgattcatgagtagaacaattgtttcacctaaa

SEQ ID NO: 120350 - DNA, 201 bp, Bos taurus; identical to SEQ ID NO: 39282

SEQ ID NO: 120351 - DNA, 201 bp, Bos taurus; identical to SEQ ID NO: 79503

SEQ ID NO: 120352 - DNA, 201 bp, Bos taurus; identical to SEQ ID NO: 39283

SEQ ID NO: 120353 - DNA, 201 bp, Bos taurus
aaacccagttgcattcagtccggaccatccaaaagaaacatcccagggaaacagtgtgaatggttagtgttggaagctgctgaaggggaggcctctttgtygcctgcttgcctgttttcttattacgtcgaggcaagaaaagggaaagtccagaaagcacaggctcccgttttagatgctggaggcccagctttgaaaagt

SEQ ID NO: 120354 - DNA, 201 bp, Bos taurus
cttcagctcaacttcctttcctattggagatggacgaaaagctggattgggaaggggaacaacactaggactttggctccaggactgtcttcctcattcayacctcatcttgcatctcccaggccttccagtggcttcctttggctgagcaagcagaaggctctcccctcaaaaaagccatgtggtggctgcctgaaccat

SEQ ID NO: 120355 - DNA, 201 bp, Bos taurus; identical to SEQ ID NO: 39284

SEQ ID NO: 120356 - DNA, 201 bp, Bos taurus
ggatcttgtgaagagcttatgagatgggccatgctgctcatgctcacagatagagtttggaaaccacacttctgtccacttgaaatgctcctgtttctttyccccaggtatacccacctgaaaggcccaccctggggtactgcactgcaggtgcaggggtttctgcaggttgaccaaacacctcaatttgtgttgggtttt

SEQ ID NO: 120357 - DNA, 201 bp, Bos taurus; identical to SEQ ID NO: 79508

SEQ ID NO: 120358 - DNA, 201 bp, Bos taurus
gtacagtcctttgtagctggcaaagctctcatttgagaatatatatggcttgtccaacatcacacagctcttctgccataaagcctggcacaggcctctckgggaggaagccaaccaggacaaaaatgtcagcatttcatcaccatcatcagtgtgatgagagagtccttggggaggctgagagaggaggccaagcaacct

SEQ ID NO: 120359 - DNA, 201 bp, Bos taurus
acccttggttaggacaccaggactctgctggttgggcccctaaggtgaaaacaagtgggctcctgtaacctcctgggaaggtgtaaagtagtgtagagtcratctcctctccccacatttgtcccagggaagacctcctcttttccctttggttctatgtgatattaactgtttttatggctgtcatgataatgttgaaca

SEQ ID NO: 120360 - DNA, 201 bp, Bos taurus
cacacacacacacacagcacatattaaggtcttaaaacggatggtacgtgtttccagattgtgattttcaattgctgccagactgaaaaggcagagaaccktaatgatcaggtctggattctttcttgggttagcttttgtaattcttgtcataccacactgatttcaaggacaagaaaaaccaagaggcaagaggttaga

SEQ ID NO: 120361 - DNA, 201 bp, Bos taurus; identical to SEQ ID NO: 79512

SEQ ID NO: 120362 - DNA, 201 bp, Bos taurus
tgctttgcatgaaaatcagagtctacagaaggggaatgatggtgcccctagagccagccagtgccctgcggagcctggtgggacctgagttattggaaaarctgacaaaattgtccagtctctgaccaggtctttgttttgttttatttttccttaagatgtgtgtttgtgtgtggaccatttttaaagtctttactgaat

SEQ ID NO: 120363 - DNA, 201 bp, Bos taurus
ggttctctgagccatatggcctgatttgcagttgaaaaagacccctgtggtccctgggagggctagctgggggggccagggcagaaggggagcccagtcayttagaaggcaggagcagggtggtgagtggtggtctaacccagaagatacagtgagagcagagctgaggggctgtgtgaagggccaggcctggggatgaca

SEQ ID NO: 120364 - DNA, 201 bp, Bos taurus
gatccaaattgcaggggtgggcagcagacacttcgtaaggtgagtgtttctggcattacactttgaggagcccccctcccatgcccattcccactctgagycctggactcagtggagaagcaggactatattaatacaccagttggagggtacctcaggacagacatgcgctcctgctggtgccaaaactatgtctttgga

SEQ ID NO: 120365 - DNA, 201 bp, Bos taurus
agcaggttcaaagaggttcactggccagcctagtgtcacacagcagagccagggacccagtccctcagtggatggtcctctcagctgcccccaaggctccrggcccctcctcctcctttcctgtcctgacctctcaaccttttctctccctcgctcacccctccctccctagggaggcagctgcctgggccagcctgtgga

SEQ ID NO: 120366 - DNA, 201 bp, Bos taurus
gcggggatgggttggtgcctcccgtcatggacaccactgacctggggcattgtgacaggcaccgtgctcagtaggtatgataacttggaggctgagaaacyggccagggaggcatggagctggggtttggtgtcccccttccccagcatcccaggcaccccctggagctccactggtggctccaaggctcctgaggagaag

SEQ ID NO: 120367 - DNA, 201 bp, Bos taurus; identical to SEQ ID NO: 79513

SEQ ID NO: 120368 - DNA, 201 bp, Bos taurus
cctatggaggacagacggggaggctcagaactccctttcagccctcctctcttccctcctgctgggtctttggtgtctgatcggggctctgggatggggcrtcagctcccgagagtggactggccagaagtcgccatttcctttgcctgctcgctcaaggtcaggccttaatccacgtgggctctccatcctggtggccac

SEQ ID NO: 120369 - DNA, 201 bp, Bos taurus; identical to SEQ ID NO: 39288

SEQ ID NO: 120370 - DNA, 201 bp, Bos taurus; identical to SEQ ID NO: 39289

SEQ ID NO: 120371 - DNA, 201 bp, Bos taurus
aaacttatgaccatatgcaaaaatgtctcagtgccaatatgtacacaagtacctacaaatctgtaatgcacagccctgtgaacacagccattgagggcagygtgttgaatgctgcaggcctgcgtgctgggacagaatgccagacacgggacagagctgcttcccacaaagcctcatgggaacccataatcccaaattata

SEQ ID NO: 120372 - DNA, 201 bp, Bos taurus; identical to SEQ ID NO: 39296

SEQ ID NO: 120373 - DNA, 201 bp, Bos taurus
ggagtgagtggaaacatcaagagggtaggtagacgcagacgtccagagttgcagggagatgtctgaacagaggcaggactgtggccttctctgcatcacamagatgctgcatttaggggagtgtgtggatggagatggagacaaggggcagccccagttgagccctgcaccccaggaccttcgtccctgagagctggagaa

SEQ ID NO: 120374 - DNA, 201 bp, Bos taurus
aattgatgacacagtagaaattagagggatcatgtcccttaataatctttagtagatgaaggggggtatcctacaaaggaagttaatgggaaagacattgmtaatcggtgagggtacagaagctaaagggttggtgatggaaagatgacaaaattatccacagaccactaaataggcagcaaaggcacaagataagactgg

SEQ ID NO: 120375 - DNA, 201 bp, Bos taurus
tggcctggagtctgagaccccagcagaggctgtggttgggcatgtgggctctggattgactggtttgtatatgtttgtacgcttgagaacaggttctttaytgtctctaggaattgggcctctgttgtttagtcaccaagtcatgtcctactcttttgcaaccccatacactgtgtagctccaccaggctcctctgtccat

SEQ ID NO: 120376 - DNA, 201 bp, Bos taurus
agctcacagggaatataggagaaaagaaagaaggcctggggccagcccacctgttcgtgttgtggttggtgcccagttccacgagatttgccctgatgctyctccagtggctttggccatggcagtggctggcctgcattgtggtgatgatggttcaggcagttacccccacagggctagctggggggaggaaaagcacag

SEQ ID NO: 120377 - DNA, 201 bp, Bos taurus
accacactgactgcagctgatgcacttagactgacaaaaagacagacatgggtaagtaacacagagatcagcacactcagaatatcctgcagagaggtcarcaaactcttccaagagatgtgagcttcctggttgcaaaaagcgacaccagcaaatgcacaggtgcgggtggcaatgtttggatggcagaaggtcacagta

SEQ ID NO: 120378 - DNA, 201 bp, Bos taurus; identical to SEQ ID NO: 39297

SEQ ID NO: 120379 - DNA, 201 bp, Bos taurus
ggagtgcagacccaccctggcccaggagcagcagcctgccaggggccgcaaggccaggagagatgggcaagcctgagatggagccctgtgctcctggggcyggtctggagggacgaggagcattacggccatggtaatggcttctgactttagaacatgttaaacaagggttcaaagctctttcctcgtagctattctgca

SEQ ID NO: 120380 - DNA, 201 bp, Bos taurus
gctgcctgggctggtgcccctgagggtgggagagtgggccgcgatgggcaaggggctgagagctagcatgacttgatttcagcctgtgcgaccctggacayggccgtcgcgtctcagaacgtctctttcctcacctgacagtgactataacttatacacagctgtttctgaggctcctcccctgggcaggagccaagggtg

SEQ ID NO: 120381 - DNA, 201 bp, Bos taurus
gttgaccggcgtggagatgagaaagttgtgttctcgcgcgaatcagaagcccggcgggtctcctctctgtgccctcctggctctttgctcagggccacacytacctttcagctgcctgttgcagtaccctcataactggttattctgccccagtcttcaccagccagagcgatctttctaaaatgccagtcagcttctgtg

SEQ ID NO: 120382 - DNA, 201 bp, Bos taurus
aaaaaaaaaaacacaaagattgtgccttgtgccaggctttggagacacaagcaggatcccatgtggatgatccctagacctcagggacccaagcgtactgrgtgtaatccaatccctcgccacctaagccaatcagggcagagcatagccccagccacagtgattggttcagaagagagtacttgaccttaagtattataa

SEQ ID NO: 120383 - DNA, 201 bp, Bos taurus; identical to SEQ ID NO: 39301

SEQ ID NO: 120384 - DNA, 201 bp, Bos taurus
gaaccctcgctcgcctgccacgcgggccctgccaccgagccacgaggctagcccgcgggccccggggtagaaaaggggggccttgacggctcatcctcggygttgtccccagagtggatgcgcgacgtgatcaatctcgctgcatttattaattcccccgtctagacagaagagaaggccgggcggcggctccttatctga

SEQ ID NO: 120385 - DNA, 201 bp, Bos taurus; identical to SEQ ID NO: 39302

SEQ ID NO: 120386 - DNA, 201 bp, Bos taurus; identical to SEQ ID NO: 39303

SEQ ID NO: 120387 - DNA, 201 bp, Bos taurus; identical to SEQ ID NO: 39304

SEQ ID NO: 120388 - DNA, 201 bp, Bos taurus; identical to SEQ ID NO: 39305

SEQ ID NO: 120389 - DNA, 201 bp, Bos taurus; identical to SEQ ID NO: 39306

SEQ ID NO: 120390 - DNA, 201 bp, Bos taurus
cagtatctttcaagaatttagtgtttatactcattttagtctagtaatatagacaaactgggttccaatcttgattcagtccttactggttctgtgacttwgggtaatgtactctgatgtactttcttcatctgaaaaatggagataataattcccaaggttgttgtgaggattaaatgagttaatatatgtaaggcactt

SEQ ID NO: 120391 - DNA, 201 bp, Bos taurus
gtacttcagagtattggagtgaatattctgaggcaaattaagtatgctctttcatctagaccagcctgagtcaggaaccatccttatttggaagggcctakgaagtggctgattgagagcaattggtgagacgctgttagaagaaccttactgtattcttctccactgttgtcaactgtcaaatgaagaaagcgagactgt

SEQ ID NO: 120392 - DNA, 201 bp, Bos taurus
gttgataagtgttatatatatatataagaaatttatttgagacattgcagcaaaaataattatggtgttgtcaataggctaggttacctcactaaaattcstagaaattcaaattaaacattaagaaatcaataaatcatctattgcattgctctaaaatgtaaaaacaaaaaacaaaaccaacttagctgttggttaaac

SEQ ID NO: 120393 - DNA, 201 bp, Bos taurus
tgtggaggtgaggaaaggaggagcccccatggcctctcaacacagtttcctgtgagctgacccctgccaggcttcgcgactttgttcccgggaacccacayacccacctccctgagggtctgcactgtgtagggggcaccacggtgcacggcttgaacccccttcaggctgaagcactcctcggtgtcgctgggagtgttg

SEQ ID NO: 120394 - DNA, 201 bp, Bos taurus
caagtgtgcagtggaaaataactcgttgccaagtagaggcccatagagtgtatttctcactatggaggctctgaaatgaacctgttggttttgatgctgaraggactggagctggcctggggcggagctgagcactagtggtgccctctggtttgtaccagaacttgaagggttgggccagcccagctgtgtgagtccagt

SEQ ID NO: 120395 - DNA, 201 bp, Bos taurus
aggtcccaccctgggccgtgctctccattctggaaccagttagcagcttttgccttaaggggatgaagattgcagggactgctggccttctagctcagagrttcctttgggggaaagtcaggaagaataggtttgtgttaggtctctgtggagaagttgtagtctgaaaattggggcccaggtatggaagcagggcaggta

SEQ ID NO: 120396 - DNA, 201 bp, Bos taurus; identical to SEQ ID NO: 39307

SEQ ID NO: 120397 - DNA, 201 bp, Bos taurus; identical to SEQ ID NO: 39308

SEQ ID NO: 120398 - DNA, 201 bp, Bos taurus; identical to SEQ ID NO: 39309

SEQ ID NO: 120399 - DNA, 201 bp, Bos taurus
agccaggccacactgcggccacagagatgaatgagaacagggccgtagactcctgcaggaggacccagcccagcccctggggaggggggcaggaatgcctytgaaagggggtaggggtggccagtccaggtgcaggaacagaatgtactgagagtgagaggcctggagtacacaggtgccccccctccttgagcagcatgg

SEQ ID NO: 120400 - DNA, 201 bp, Bos taurus; identical to SEQ ID NO: 39310

SEQ ID NO: 120401 - DNA, 201 bp, Bos taurus
ccagcatagaaacagcttagtgttcttcgaagcacctcatgcttgtattctcccaagcctttgcgcttgttctcgtttaggcctatagcacctcttccccyggtcactgtctgttctaccttcaatactcttctcaaacgttctctccgggggctgtgggcctccatgtgcctaatgccctcactgtggtccatgtctctg

SEQ ID NO: 120402 - DNA, 201 bp, Bos taurus; identical to SEQ ID NO: 39314

SEQ ID NO: 120403 - DNA, 201 bp, Bos taurus; identical to SEQ ID NO: 39315

SEQ ID NO: 120404 - DNA, 201 bp, Bos taurus
tctaatggggccaggaggaaggaggacacaaaagagtaagttctgtaagggagaaagtgccagaaagtatcaggagagcaaagtagactcttgcgggggargggtatagaatttgcaggtaaaggccacaaaccagaggggggatatacagctagatttgcaggaatggaggggcagcttcatataacttcattctcacta

SEQ ID NO: 120405 - DNA, 201 bp, Bos taurus
aaatgacttgaatgatatgaggatcccgaatgcagagtaccagggacagagcctcactccattaaggtgttccagggagggccaagttctcagtaaggaaygattcatggtttccaggaaagtacagccccagaaatgggacccaaaggtataaagattcctgagcctgtctatagtacagtcacagcagggcctctcatt

SEQ ID NO: 120406 - DNA, 201 bp, Bos taurus; identical to SEQ ID NO: 39317

SEQ ID NO: 120407 - DNA, 201 bp, Bos taurus
aaggaaaacaaaggcagcacttgtatgtggactgatgttaagggcacggtttggtttcaggttctgattctagagtcctggggcagctgctgctttttttyccttatttatttttggctatgctgggtcttcgttgctgacaggcttttctctggttttggtgatcgagggctattctccagttgcggtgcacgggcttct

SEQ ID NO: 120408 - DNA, 201 bp, Bos taurus
tgaccaatgaacatgtactttagatggagaagatgattctgaccattaatgaatttaaatgaaagaatgacctgtccagtttaatgatggacttatttatracacagattcgagctattttgagttcagtatcctgatctttaatttctctcttagcttaaaaagtacaccttcttttcacttacattttaatatgaaata

SEQ ID NO: 120409 - DNA, 201 bp, Bos taurus
gctgttacagcatgacagcaagcacaggcaacagataaatgaacaggcagcctgtgttccaagagaacgttatttacaaaaacaagtggccagtccacaarctggagtttgcagatacctaattaactcaatggaacaaacacgtatgatggacatacacatatgcagaacatcaaggccagatgctgaggagtgtgctgc

SEQ ID NO: 120410 - DNA, 201 bp, Bos taurus
ccagagagcttcatcctcgtcccactaagccaatataaatggtatggtcccagggacagtcaccaaccttttctaggcctgtttccttctatataatattwtggaggctgaaaactatttcctgccagctgtaaaaccctgtgattctaaagtctctgtttatggtttggcctcagtagacagaattaccatgacatgaaa

SEQ ID NO: 120411 - DNA, 201 bp, Bos taurus
agcagccaggaagaactgtgtttcaatttctattcaatcacttgcatgctctctggctttgtggctttcatttaacttcttctaaccctagttttctattmcatgagataagaaatatgtgactgcccatctcttagagatattgtgaagattaaataaggtcaatatgataagtttgtcacctagcaggcactcaacaat

SEQ ID NO: 120412 - DNA, 201 bp, Bos taurus
gcttttgaacacctgctgaccagcctgcttggtccagatctggcctttcctccaaacttgctggctgaagtgtttgtaactttctgtagaaggccagacaygctctccttgttctagaggagggtattacagatcattagctacctaatcactaaagttcttaactgaggaattctcccaggtagacgtgctttccctgta

SEQ ID NO: 120413 - DNA, 201 bp, Bos taurus; identical to SEQ ID NO: 39318

SEQ ID NO: 120414 - DNA, 201 bp, Bos taurus; identical to SEQ ID NO: 39319

SEQ ID NO: 120415 - DNA, 201 bp, Bos taurus
aaatctttgctctcttcgaaacctgtcagaaaattaggtcaacatgattttgtattttaatgaaataacttaagggtaagcctgagacttggaggccgctragacttttatgctagagtggcttgtcatgcttgacgtaatgtctggctccgtatgagaggggtatcgaagctaatgttctccatggctaatcggccttta

SEQ ID NO: 120416 - DNA, 201 bp, Bos taurus
tcttttttttttttttaattctatattatagcaggaaataacaaatgaataaacaaactacttcacccaaacaggccaaagggcccttattgggaacaacrtcaatgccatattctctactatcctcaactctttgtcagctgagacctgtcagacatggcctcaaacatagtctgagttgatgggcctaattaaaaaagc

SEQ ID NO: 120417 - DNA, 201 bp, Bos taurus; identical to SEQ ID NO: 39321

SEQ ID NO: 120418 - DNA, 201 bp, Bos taurus; identical to SEQ ID NO: 39322

SEQ ID NO: 120419 - DNA, 201 bp, Bos taurus
atcaaaattattaccaaggtggtaaatgatgaggcttcagtgtattcaaatgatgttgtatcatcaggaaaaatccatccaaagaatacatttagatatcyggcctttgaaagttctctagactaagcagtctatttcccacgtccaaattgaatgacagaagattcttttaatttaaattttaaagtttctattcagcct

SEQ ID NO: 120420 - DNA, 201 bp, Bos taurus
ttccagttgaggacactaaagcacaaagaggctttgcacaaagtcacagaacaactccacagcaaaggcaagaccagagacccatggccatggtctcccayttcactgttgtgtgccctggaccactgagtcatcctggtggcacagatggtaaacaccctgcctgcaatgtaagagacccaggttcaatctctgggtcag

SEQ ID NO: 120421 - DNA, 201 bp, Bos taurus; identical to SEQ ID NO: 39325

SEQ ID NO: 120422 - DNA, 201 bp, Bos taurus; identical to SEQ ID NO: 39326

SEQ ID NO: 120423 - DNA, 201 bp, Bos taurus; identical to SEQ ID NO: 39327

SEQ ID NO: 120424 - DNA, 201 bp, Bos taurus; identical to SEQ ID NO: 39328

SEQ ID NO: 120425 - DNA, 201 bp, Bos taurus; identical to SEQ ID NO: 39329

SEQ ID NO: 120426 - DNA, 201 bp, Bos taurus; identical to SEQ ID NO: 39331

SEQ ID NO: 120427 - DNA, 201 bp, Bos taurus; identical to SEQ ID NO: 39332

SEQ ID NO: 120428 - DNA, 201 bp, Bos taurus; identical to SEQ ID NO: 39333

SEQ ID NO: 120429 - DNA, 201 bp, Bos taurus; identical to SEQ ID NO: 39334

SEQ ID NO: 120430 - DNA, 201 bp, Bos taurus; identical to SEQ ID NO: 39335

SEQ ID NO: 120431 - DNA, 201 bp, Bos taurus; identical to SEQ ID NO: 39336

SEQ ID NO: 120432 - DNA, 201 bp, Bos taurus; identical to SEQ ID NO: 39337

SEQ ID NO: 120433 - DNA, 201 bp, Bos taurus; identical to SEQ ID NO: 39338

SEQ ID NO: 120434 - DNA, 201 bp, Bos taurus; identical to SEQ ID NO: 39339

SEQ ID NO: 120435 - DNA, 201 bp, Bos taurus; identical to SEQ ID NO: 39340

SEQ ID NO: 120436 - DNA, 201 bp, Bos taurus; identical to SEQ ID NO: 39341

SEQ ID NO: 120437 - DNA, 201 bp, Bos taurus; identical to SEQ ID NO: 39342

SEQ ID NO: 120438 - DNA, 201 bp, Bos taurus; identical to SEQ ID NO: 39343

SEQ ID NO: 120439 - DNA, 201 bp, Bos taurus; identical to SEQ ID NO: 39344

SEQ ID NO: 120440 - DNA, 201 bp, Bos taurus; identical to SEQ ID NO: 39345

SEQ ID NO: 120441 - DNA, 201 bp, Bos taurus; identical to SEQ ID NO: 39346

SEQ ID NO: 120442 - DNA, 201 bp, Bos taurus; identical to SEQ ID NO: 39347

SEQ ID NO: 120443 - DNA, 201 bp, Bos taurus; identical to SEQ ID NO: 39348

SEQ ID NO: 120444 - DNA, 201 bp, Bos taurus; identical to SEQ ID NO: 39349

SEQ ID NO: 120445 - DNA, 201 bp, Bos taurus; identical to SEQ ID NO: 39350

SEQ ID NO: 120446 - DNA, 201 bp, Bos taurus; identical to SEQ ID NO: 39351

SEQ ID NO: 120447 - DNA, 201 bp, Bos taurus; identical to SEQ ID NO: 39352

SEQ ID NO: 120448 - DNA, 201 bp, Bos taurus; identical to SEQ ID NO: 39353

SEQ ID NO: 120449 - DNA, 201 bp, Bos taurus; identical to SEQ ID NO: 39354

SEQ ID NO: 120450 - DNA, 201 bp, Bos taurus; identical to SEQ ID NO: 39355

SEQ ID NO: 120451 - DNA, 201 bp, Bos taurus; identical to SEQ ID NO: 39356

SEQ ID NO: 120452 - DNA, 201 bp, Bos taurus; identical to SEQ ID NO: 39357

SEQ ID NO: 120453 - DNA, 201 bp, Bos taurus; identical to SEQ ID NO: 39358

SEQ ID NO: 120454 - DNA, 201 bp, Bos taurus; identical to SEQ ID NO: 39359

SEQ ID NO: 120455 - DNA, 201 bp, Bos taurus; identical to SEQ ID NO: 39360

SEQ ID NO: 120456 - DNA, 201 bp, Bos taurus; identical to SEQ ID NO: 39361

SEQ ID NO: 120457 - DNA, 201 bp, Bos taurus; identical to SEQ ID NO: 39362

SEQ ID NO: 120458 - DNA, 201 bp, Bos taurus; identical to SEQ ID NO: 39363

SEQ ID NO: 120459 - DNA, 201 bp, Bos taurus; identical to SEQ ID NO: 39364

SEQ ID NO: 120460 - DNA, 201 bp, Bos taurus; identical to SEQ ID NO: 39365

SEQ ID NO: 120461 - DNA, 201 bp, Bos taurus; identical to SEQ ID NO: 39366

SEQ ID NO: 120462 - DNA, 201 bp, Bos taurus; identical to SEQ ID NO: 39367

SEQ ID NO: 120463 - DNA, 201 bp, Bos taurus; identical to SEQ ID NO: 39368

SEQ ID NO: 120464 - DNA, 201 bp, Bos taurus; identical to SEQ ID NO: 39369

SEQ ID NO: 120465 - DNA, 201 bp, Bos taurus; identical to SEQ ID NO: 39370

SEQ ID NO: 120466 - DNA, 201 bp, Bos taurus; identical to SEQ ID NO: 39371

SEQ ID NO: 120467 - DNA, 201 bp, Bos taurus; identical to SEQ ID NO: 39372

SEQ ID NO: 120468 - DNA, 201 bp, Bos taurus; identical to SEQ ID NO: 39373

SEQ ID NO: 120469 - DNA, 201 bp, Bos taurus; identical to SEQ ID NO: 39374

SEQ ID NO: 120470 - DNA, 201 bp, Bos taurus; identical to SEQ ID NO: 39375

SEQ ID NO: 120471 - DNA, 201 bp, Bos taurus; identical to SEQ ID NO: 39376

SEQ ID NO: 120472 - DNA, 201 bp, Bos taurus; identical to SEQ ID NO: 39377

SEQ ID NO: 120473 - DNA, 201 bp, Bos taurus; identical to SEQ ID NO: 39378

SEQ ID NO: 120474 - DNA, 201 bp, Bos taurus; identical to SEQ ID NO: 39379

SEQ ID NO: 120475 - DNA, 201 bp, Bos taurus; identical to SEQ ID NO: 39380

SEQ ID NO: 120476 - DNA, 201 bp, Bos taurus; identical to SEQ ID NO: 39381

SEQ ID NO: 120477 - DNA, 201 bp, Bos taurus; identical to SEQ ID NO: 39382

SEQ ID NO: 120478 - DNA, 201 bp, Bos taurus; identical to SEQ ID NO: 39383

SEQ ID NO: 120479 - DNA, 201 bp, Bos taurus; identical to SEQ ID NO: 39384

SEQ ID NO: 120480 - DNA, 201 bp, Bos taurus; identical to SEQ ID NO: 39385

SEQ ID NO: 120481 - DNA, 201 bp, Bos taurus; identical to SEQ ID NO: 39386

SEQ ID NO: 120482 - DNA, 201 bp, Bos taurus; identical to SEQ ID NO: 39387

SEQ ID NO: 120483 - DNA, 201 bp, Bos taurus; identical to SEQ ID NO: 39388

SEQ ID NO: 120484 - DNA, 201 bp, Bos taurus; identical to SEQ ID NO: 39389

SEQ ID NO: 120485 - DNA, 201 bp, Bos taurus; identical to SEQ ID NO: 39390

SEQ ID NO: 120486 - DNA, 201 bp, Bos taurus; identical to SEQ ID NO: 39391

SEQ ID NO: 120487 - DNA, 201 bp, Bos taurus; identical to SEQ ID NO: 39392

SEQ ID NO: 120488 - DNA, 201 bp, Bos taurus; identical to SEQ ID NO: 39393

SEQ ID NO: 120489 - DNA, 201 bp, Bos taurus; identical to SEQ ID NO: 39394

SEQ ID NO: 120490 - DNA, 201 bp, Bos taurus
ctgttgcctctttttaaagtatggttacaccaattttgtctgcatgactgaaaatatgaacacttggtagagcttagaagccttatggtgagccacttccwatctctttgggcttgtctcaaaacagcacatcctcgctctctgtgtcagctacactgatctgccagtcccccaaatgtgtgtgctccttctgcctcaggg

SEQ ID NO: 120491 - DNA, 201 bp, Bos taurus
atatgttttccactcttctcaaaaacttctttggaaattaggacatgatggagattatgtgtgtttttcattcctaataagttcaaatgtgattggattgkttttttgggaaagaggaaattgaataccttgaacctatttcttttgaaacagaaactttttttcctatcagttggaaacactcagtagagtgcaaaccat

SEQ ID NO: 120492 - DNA, 201 bp, Bos taurus
gaaataagattagaaaaaatagattggagagaaattgtggaaagttctaaatgttgtgccaaggaatttgtattgtgtgtgtgtggcaggggggaccttcyaaagggttcaaactgggaaacagtggctggcactttgttttggcatcagaacattggaaatgactaggggcaggtaaagatatgaacggcaagaaaacca

SEQ ID NO: 120493 - DNA, 201 bp, Bos taurus
agaattaacatttttaaggatttttgttcctgtaacagctattaataattaattaactaataaattaactatatgattataattttatttcccatgtaatyctgactctggagaaagataggctggtcttgcatatgtaaatgttctgggttgacgtcattatcttgcaagcttggttaactgtcagttcacctctgagta

SEQ ID NO: 120494 - DNA, 201 bp, Bos taurus
tcctgcgcctgcgcagccaccgctccttggatatggggttggtcctcccggttgccgcccctgacctcggaggcagggtagctcctctgggctgctgcccytgaccttggacaaagacttcaggccatagatataaataggaacacatcaaatatcaagactcccacaaggaagagtatatccaactcaaacaacctagtc

SEQ ID NO: 120495 - DNA, 201 bp, Bos taurus
cacagccctgcatcagaatcacccaagaacttatgaaaatgcatattctctaagctctatgttagagaccttgattcattaggtctgggatgaaccttggyatttctaaagtacttaaaagtgtgagaactaccagtttaactgctaagagcatggagtttgccatcagcagctgtagctctgctttcttcattgggtgat

SEQ ID NO: 120496 - DNA, 201 bp, Bos taurus
tgaaagtacaaacaactagaccgtgactgctaagaattagtggccacaaacccatatggaagagtaagcagccatgtgcacacgtggcacccagcaccagkactctgcctgattgtatcttggccaaagacatcacgaggtaccccgctcttctttccacctcgcctcccaccctgccagcatctgtcttcacacttctca

SEQ ID NO: 120497 - DNA, 201 bp, Bos taurus
acagggacatcccttttccttattgccactatagccactgcccttttgattcaagccacaaaaaatcattgtgggatcccctttcaccatttttgtactayagaaagtacatgctatagaagccctcctgaattatcaccacactcaacacttctcagtcagctgcttttgttaactgatcctcacatttatgttgtaata

SEQ ID NO: 120498 - DNA, 201 bp, Bos taurus; identical to SEQ ID NO: 39404

SEQ ID NO: 120499 - DNA, 201 bp, Bos taurus; identical to SEQ ID NO: 39407

SEQ ID NO: 120500 - DNA, 201 bp, Bos taurus; identical to SEQ ID NO: 39408

SEQ ID NO: 120501 - DNA, 201 bp, Bos taurus; identical to SEQ ID NO: 39416

SEQ ID NO: 120502 - DNA, 201 bp, Bos taurus
aaatttctatagtaaaactctaagccccagtacctcagagtgtgaccagatttggagatgaggcctttaaaaacgtgatagaattaaaaagaggccattgraatgagacctaattacttaatctgactggtatccttataagaagaggaaattcaggcgcacagagggaggccaggcactcagggccgtgtgtgcacagag

SEQ ID NO: 120503 - DNA, 201 bp, Bos taurus; identical to SEQ ID NO: 39417

SEQ ID NO: 120504 - DNA, 201 bp, Bos taurus
gaactttgaatatcttcaacatatttatttattaaagttcagaaggacatttgatgagatcgaatagcttaaaaggatagtcgtgaaaagtataataaagkttattgtagagaaatgtgattgacaatttctgctttaaaagtgcacttggagggagtaaatataagacagggtaatagaaaagcccattttgtgaaatag

SEQ ID NO: 120505 - DNA, 201 bp, Bos taurus
ggagaaggtgaaccaccacacagatcctacaaatcctaggccaacctgggtggaggggggagctatggatctactgctgactcctcagagtgtcccacatygagtgaagtgtgcaggcctttacacacctgtcttgcttagtcactgtatgccagctgttcaggcccagatatgaactcaagggaaagactctgcagctga

SEQ ID NO: 120506 - DNA, 201 bp, Bos taurus
aaaaccccaaggtctgtagtttgtaaaccaaaaaagccaatggtgtaatgcaatctcagtcccaaaatccaggaaccagaggagccaatggtgatagtacmaatctgagtagaaaggcctgagaattgagggtcattggtattaaggtcctatccaaagacataatacccagtggtgttgatgttggagggcaggagaaga

SEQ ID NO: 120507 - DNA, 201 bp, Bos taurus
cctatttagagagtattcaaagaaaagcttttaaactgtgagttttcttaggtgctgaaataaaaataatatatattaattatagtttgtgatcacaacayatttcaatgactttgttgctgtgctgtctccactttatgtaaataaaattttcatttaaaatacattcttaaaacctagaagttagttgacaaaacaaca

SEQ ID NO: 120508 - DNA, 201 bp, Bos taurus
ttggctgacttcctcaggagctttctttagatactgtatgttcacacagtttgttcgggagattattgaggcggaagctagggaagagatctgatcatttkttagttacttgactcattctactttgaatcacagaaagaacccacaagttaggcaggtattgtgagatcaaaagatttgaaaggtatgcttggccagaga

SEQ ID NO: 120509 - DNA, 201 bp, Bos taurus
ctttggcgatatccttttgaatacaagatggcctgagctcactgggtgtcagttcaaaccaatttgaatcttttgaagatcgagatattgtagcaacattmtgtgaattaggatcaagttccccaattctaacatttaatcttgcactctgttccagtgcacaactggacagattccaatagcaaagaatatcattttcag

SEQ ID NO: 120510 - DNA, 201 bp, Bos taurus
atgcttaattgcagcccagaagggactgctcacgtttcatagagagctgtcctatggacccaccagctacaaggtaagagccaggtggaaggacaggagtytgggaaatagttcttgaaaagtagctgtttcctagcaataatactctacttgccaaaagaagggaaatttactacttaagtttctaattgtctctgccac

SEQ ID NO: 120511 - DNA, 201 bp, Bos taurus
gtaaagtttccattttgtggcttaggaattgtccaactgagggaaacaacaagaccaggaaagaattcttgcttctgttgaaacctttccaaggggtaggrggttctttggaagggcttgttagccatttctcatggactgtgtaggcagttaggaagaagggaagcaaaacagaatggactcttagtttagaggatggtg

SEQ ID NO: 120512 - DNA, 201 bp, Bos taurus; identical to SEQ ID NO: 39419

SEQ ID NO: 120513 - DNA, 201 bp, Bos taurus; identical to SEQ ID NO: 39420

SEQ ID NO: 120514 - DNA, 201 bp, Bos taurus; identical to SEQ ID NO: 39421

SEQ ID NO: 120515 - DNA, 201 bp, Bos taurus; identical to SEQ ID NO: 39423

SEQ ID NO: 120516 - DNA, 201 bp, Bos taurus; identical to SEQ ID NO: 39426

SEQ ID NO: 120517 - DNA, 201 bp, Bos taurus; identical to SEQ ID NO: 39427

SEQ ID NO: 120518 - DNA, 201 bp, Bos taurus
cctggcctccctgggtgggggaggccccgaggccgtggagtgagcagtcatgcaactcccaccaaacgcagccattgtcctcacatcctgcaaagcccctrtgcgtctctggggcctcatttcatgagggcccactcatttcatgacagggcgctcaccttcctgagaggtgaccccaggcccaaaggtccctgcgcaggt

SEQ ID NO: 120519 - DNA, 201 bp, Bos taurus; identical to SEQ ID NO: 39428

SEQ ID NO: 120520 - DNA, 201 bp, Bos taurus; identical to SEQ ID NO: 39430

SEQ ID NO: 120521 - DNA, 201 bp, Bos taurus; identical to SEQ ID NO: 79691

SEQ ID NO: 120522 - DNA, 201 bp, Bos taurus; identical to SEQ ID NO: 39431

SEQ ID NO: 120523 - DNA, 201 bp, Bos taurus; identical to SEQ ID NO: 39432

SEQ ID NO: 120524 - DNA, 201 bp, Bos taurus
gagagcttgtgacatgtggtagctcaggtcccaggttgatgagagccagtccatgcaacaaacctccacgtgactgcgatggcctctaagtgccccaagtyatcaaagcctggtttctgatagaagtctgtgcacaacatgctctgcaggtgcagccactgggcagacagtgcttcggagcctgtcaggagttggccctgt

SEQ ID NO: 120525 - DNA, 201 bp, Bos taurus; identical to SEQ ID NO: 79730

SEQ ID NO: 120526 - DNA, 201 bp, Bos taurus
ccatttttatagatgagtaagtctcaggagaaaaaaaagtttaactttggaacagtgtcttcctcgaccaggccttcttaatcatttaatgaagcaagcaygtcttctcagaagcatctggcccgtttcagtcctcccgaatccccgtctcccagagtgccctgttacacaggccaccgatgtggcagagacctgctctca

SEQ ID NO: 120527 - DNA, 201 bp, Bos taurus
catctctgtactccagggtctcagtgtttgggctgtggggtgagggcagaagcggagccaccgcggtaatgtcgggctaactctgtgaccttggtagtacygctgccactctgagtgccacgggctctgtacacacacgggttcactgcaccctgaaagcggtgccgtggaaaagcagcagccccatgacccccaggagga

SEQ ID NO: 120528 - DNA, 201 bp, Bos taurus
ccggccggtgagggcgtcctgaagtgctggctcccaccagggcggctgcctgggagacgcagcgcccttggctctgggttctgggcaccatccgtttttgyggtgttgcaggccggtggcttatttgccctaatgaggttttgattactctccatttgtctctttcatcagctttatgttaaaaagcctttttatttggat

SEQ ID NO: 120529 - DNA, 201 bp, Bos taurus; identical to SEQ ID NO: 79734

SEQ ID NO: 120530 - DNA, 201 bp, Bos taurus
gaaagccagggtggctagagcacaggaatgtgggggttggggcagagcctcagaggcggcaaggaccagtctaagtggggccttggaggccttctcgggtrtttggtctcctctctaacttcacttgaaaagcactgggattctgcaggggttgggcaagggaaaagaggcccaggcatcttccccaaagaccctctcctc

SEQ ID NO: 120531 - DNA, 201 bp, Bos taurus; identical to SEQ ID NO: 79737

SEQ ID NO: 120532 - DNA, 201 bp, Bos taurus; identical to SEQ ID NO: 79741

SEQ ID NO: 120533 - DNA, 201 bp, Bos taurus
ccagagcctctctcccaccatgagatgagtcactccgtgtccagggtgggcaggggccgaacagactcccgaactggccatgaaaagcaccctgaagatcyggttgcttgagatcaaagtcaggtcagtaattacaagaacggaagcatggtttgttccagccccttccctgggcctcaccatctgtcgcagactcaccag

SEQ ID NO: 120534 - DNA, 201 bp, Bos taurus; identical to SEQ ID NO: 79742

SEQ ID NO: 120535 - DNA, 201 bp, Bos taurus
ggaggttgggggactgcttagggacaaaggaagaccgcttaggaggcggggttcacggcgccccgggcagagggaaggggccggggctcctgcgacccggrgttcgagtggtggagtccggagaagaaaaatgaagggagagcctgggaaccccgaaagaggggtctcccagacagagctgccgactgcggggccggaagg

SEQ ID NO: 120536 - DNA, 201 bp, Bos taurus; identical to SEQ ID NO: 79743

SEQ ID NO: 120537 - DNA, 201 bp, Bos taurus; identical to SEQ ID NO: 79744

SEQ ID NO: 120538 - DNA, 201 bp, Bos taurus; identical to SEQ ID NO: 79745

SEQ ID NO: 120539 - DNA, 201 bp, Bos taurus
gtttcctaaaatgaggtttctacaggcctgagcctttctcactaacagtggactgacttctgtcatcttagcaactaacccttttctcccgtcccggcgcrccctggccagtgggcccagcgggcgtgtcttctggaagaagtgtcttctgaagcagtgtcccctgtagaggtgagccagctgacacccccccagacagcc

SEQ ID NO: 120540 - DNA, 201 bp, Bos taurus; identical to SEQ ID NO: 79746

SEQ ID NO: 120541 - DNA, 201 bp, Bos taurus; identical to SEQ ID NO: 79747

SEQ ID NO: 120542 - DNA, 201 bp, Bos taurus
cacagcctacttgccatgacgtcaaccacctaacagccaccgcggaaagcgtctccctcctagtgggcttttccgcaggccaagtccagcttatagacccratcaaaaaagaaactagcaaactatttaatgaggaagtaagtagcaccctgtcttagctgttaagaacccctataagaatgtatacgttcttaccgaggg

SEQ ID NO: 120543 - DNA, 201 bp, Bos taurus
ggcggggggagccgtgaggacccctcagagaagcacaggccaggtgttggggctcagaggaggggctgggagcccatcctgtaggcttcacggccccactyggcgctgtgttactccagcgcttgagagtcacgagtggcattgactctggctgccctgtggagggggcgagggcggccaccacggaggccaccagggtcc

SEQ ID NO: 120544 - DNA, 201 bp, Bos taurus
ctctgccacaaagtgggcctttgtgttggcgtccactgcccccagcaaggaaggtgggttggggtgccactgaacggttaaatccatggtctgatgtggtygagttggggtgggagcctggccgtggtggtgtcacgggcgagggcccccgaagctggacaggagagaagagcctggtgtggggtgctgagggagtcgagt

SEQ ID NO: 120545 - DNA, 201 bp, Bos taurus
acgtgtggctgtgactgggaatggactgactccagaggcctctgtccacggctacaaggtcggcaggaggacttccgcctcttgactatgtacgggctaartgaacaaaaaggccacaacctcacctccacgtttcctgtcttcaagactctagtgacactgggaatgatacacaacttcctatgatgcttctaagcgcct

SEQ ID NO: 120546 - DNA, 201 bp, Bos taurus; identical to SEQ ID NO: 79752

SEQ ID NO: 120547 - DNA, 201 bp, Bos taurus; identical to SEQ ID NO: 79753

SEQ ID NO: 120548 - DNA, 201 bp, Bos taurus
tcactgagggccggggggaggcttccgcctgctgggaggctgcccaccgctctgcactcccggtcctgtgggacgagggggttgccctgagggtcacctgyctgggggcactggcccaccttccctatttacagcaagaaagcaaggcccaggcctgtgctcagggtcccaggctggcacgtggcagagctgggctatgag

SEQ ID NO: 120549 - DNA, 201 bp, Bos taurus; identical to SEQ ID NO: 79756

SEQ ID NO: 120550 - DNA, 201 bp, Bos taurus; identical to SEQ ID NO: 79758

SEQ ID NO: 120551 - DNA, 201 bp, Bos taurus; identical to SEQ ID NO: 79759

SEQ ID NO: 120552 - DNA, 201 bp, Bos taurus
aagccctgccgagcggactgcgcgtgcgtgtcttaggactccaaggaaggatgctgacgttgaccgatgcgataaagagacgcagtcagcacggctgggcygactgtgcccaggtgagtgtccagaccagtgtcctgcaaatccgagcctcagcaggcttttttaggaaactcctcctaaatctgcccgcagagactgaag

SEQ ID NO: 120553 - DNA, 201 bp, Bos taurus; identical to SEQ ID NO: 79763

SEQ ID NO: 120554 - DNA, 201 bp, Bos taurus; identical to SEQ ID NO: 79764

SEQ ID NO: 120555 - DNA, 201 bp, Bos taurus; identical to SEQ ID NO: 79766

SEQ ID NO: 120556 - DNA, 201 bp, Bos taurus; identical to SEQ ID NO: 39458

SEQ ID NO: 120557 - DNA, 201 bp, Bos taurus; identical to SEQ ID NO: 39459

SEQ ID NO: 120558 - DNA, 201 bp, Bos taurus; identical to SEQ ID NO: 79770

SEQ ID NO: 120559 - DNA, 201 bp, Bos taurus; identical to SEQ ID NO: 79771

SEQ ID NO: 120560 - DNA, 201 bp, Bos taurus; identical to SEQ ID NO: 79772

SEQ ID NO: 120561 - DNA, 201 bp, Bos taurus; identical to SEQ ID NO: 79775

SEQ ID NO: 120562 - DNA, 201 bp, Bos taurus; identical to SEQ ID NO: 39463

SEQ ID NO: 120563 - DNA, 201 bp, Bos taurus; identical to SEQ ID NO: 39464

SEQ ID NO: 120564 - DNA, 201 bp, Bos taurus; identical to SEQ ID NO: 39468

SEQ ID NO: 120565 - DNA, 201 bp, Bos taurus; identical to SEQ ID NO: 39469

SEQ ID NO: 120566 - DNA, 201 bp, Bos taurus; identical to SEQ ID NO: 39470

SEQ ID NO: 120567 - DNA, 201 bp, Bos taurus; identical to SEQ ID NO: 39471

SEQ ID NO: 120568 - DNA, 201 bp, Bos taurus; identical to SEQ ID NO: 79779

SEQ ID NO: 120569 - DNA, 201 bp, Bos taurus; identical to SEQ ID NO: 79780

SEQ ID NO: 120570 - DNA, 201 bp, Bos taurus; identical to SEQ ID NO: 39472

SEQ ID NO: 120571 - DNA, 201 bp, Bos taurus; identical to SEQ ID NO: 79783

SEQ ID NO: 120572 - DNA, 201 bp, Bos taurus; identical to SEQ ID NO: 39476

SEQ ID NO: 120573 - DNA, 201 bp, Bos taurus; identical to SEQ ID NO: 79786

SEQ ID NO: 120574 - DNA, 201 bp, Bos taurus; identical to SEQ ID NO: 79787

SEQ ID NO: 120575 - DNA, 201 bp, Bos taurus; identical to SEQ ID NO: 79788

SEQ ID NO: 120576 - DNA, 201 bp, Bos taurus; identical to SEQ ID NO: 39478

SEQ ID NO: 120577 - DNA, 201 bp, Bos taurus; identical to SEQ ID NO: 39479

SEQ ID NO: 120578 - DNA, 201 bp, Bos taurus; identical to SEQ ID NO: 79789

SEQ ID NO: 120579 - DNA, 201 bp, Bos taurus; identical to SEQ ID NO: 39480

SEQ ID NO: 120580 - DNA, 201 bp, Bos taurus; identical to SEQ ID NO: 39481

SEQ ID NO: 120581 - DNA, 201 bp, Bos taurus
gctcagatctcacatgccttgtggccaacaaagcagaaggggataaaaagcccttattctccattatgtgtgggtgctatagctaagtgagcactgacctrtggccaacatggggttttccttgtgattctcagatcatcttacaagaaataacctctggtgccacaggcaactgactgcatggtggtggctttgttgaaa

SEQ ID NO: 120582 - DNA, 201 bp, Bos taurus; identical to SEQ ID NO: 39482

SEQ ID NO: 120583 - DNA, 201 bp, Bos taurus; identical to SEQ ID NO: 39483

SEQ ID NO: 120584 - DNA, 201 bp, Bos taurus
ttcatctgctttgtctatcctaggctaatatattgctggttgctaaacaccttcttaagaaaaataaagacaaagaggtaaacgtggctgtttgtagactraaccaggacaagctgaggtcttggtccaggctgatgagattgatcttcctacctcccaggctcttccaggcattccagtcttatggtgataaatgccaag

SEQ ID NO: 120585 - DNA, 201 bp, Bos taurus
atggcctgtgcctgcctcaccctcccaagccccacactttgtgcttcaggcaccaggggtcatgcagattctgtactgtatccacccttggcctttgtcckctaaatacacacacacacacacacacacacacactgcaagctcaagtctttgattttgttcatgcttcctcgttatatggaatgctcctcccactcccaa

SEQ ID NO: 120586 - DNA, 201 bp, Bos taurus
agtggatgaggcctgggcttacctatttcttccttgcacgtctggtgcctaagccaagatgatgcgggtggctggggctcactggagctcctgggagtaayatcaaggcctcctcaagtgtcttctccagaatgcctcattatcatagccaccttagggtggtcagatttcctactcagcagtgcggaattccaacagcaa

SEQ ID NO: 120587 - DNA, 201 bp, Bos taurus; identical to SEQ ID NO: 39487

SEQ ID NO: 120588 - DNA, 201 bp, Bos taurus; identical to SEQ ID NO: 39488

SEQ ID NO: 120589 - DNA, 201 bp, Bos taurus; identical to SEQ ID NO: 39489

SEQ ID NO: 120590 - DNA, 201 bp, Bos taurus
aagtagctatcttcctggttaactatagtgaacgattaagtgtgatagacggggagaaatgtagcaaagcccatttgatcaaagttctctctgtgtcaccrtctttggatggcccagcaaacagctgtctgccaaatattaacattttttaccttcctgtgaattatcttactttcctttggagtctgagacccttatttc

SEQ ID NO: 120591 - DNA, 201 bp, Bos taurus; identical to SEQ ID NO: 39491

SEQ ID NO: 120592 - DNA, 201 bp, Bos taurus; identical to SEQ ID NO: 39492

SEQ ID NO: 120593 - DNA, 201 bp, Bos taurus; identical to SEQ ID NO: 39493

SEQ ID NO: 120594 - DNA, 201 bp, Bos taurus; identical to SEQ ID NO: 39494

SEQ ID NO: 120595 - DNA, 201 bp, Bos taurus; identical to SEQ ID NO: 39495

SEQ ID NO: 120596 - DNA, 201 bp, Bos taurus; identical to SEQ ID NO: 39496

SEQ ID NO: 120597 - DNA, 201 bp, Bos taurus; identical to SEQ ID NO: 39497

SEQ ID NO: 120598 - DNA, 201 bp, Bos taurus; identical to SEQ ID NO: 79807

SEQ ID NO: 120599 - DNA, 201 bp, Bos taurus; identical to SEQ ID NO: 79809

SEQ ID NO: 120600 - DNA, 201 bp, Bos taurus; identical to SEQ ID NO: 79810

SEQ ID NO: 120601 - DNA, 201 bp, Bos taurus; identical to SEQ ID NO: 79811

SEQ ID NO: 120602 - DNA, 201 bp, Bos taurus; identical to SEQ ID NO: 79816

SEQ ID NO: 120603 - DNA, 201 bp, Bos taurus
ccacttctcctgcagaagagcaagtgttggggaatgaggaagaagggtctgtcttatatatatcagatgagatctgaggcctccagtggtcagtccacccyggtggttggatgtggtgttccccgtcctcaaaaatgatgagctggaaatcggggtgttacatctgtggggatgagctcccctcaaagtgtaagcagaggg

SEQ ID NO: 120604 - DNA, 201 bp, Bos taurus
gatggggagcggctacaaatacagatgaagcttcactcacctcctgttgtggcccggttcctaacagaccacagaccaatatcagtttgttgcctggcctytggggacccctgttctagtccagagaccttaatctgaatctaatcatgaagaaacagcagagaaacctcaatggaggactttttataaaataactggcct

SEQ ID NO: 120605 - DNA, 201 bp, Bos taurus
aggctaagaatgttactggtttaccatgaattttagagcagaaatctgtgtcagtatctatataaattgttaacgtgtgaggccagatcactgtgagaaakaatgataaacataatcaaaggatcctgactggaggagagttttgttatgctgtcagggtttggttgaaagcacctagcacagcctcggcctctgtcctgc

SEQ ID NO: 120606 - DNA, 201 bp, Bos taurus; identical to SEQ ID NO: 79818

SEQ ID NO: 120607 - DNA, 201 bp, Bos taurus
ggtccaagtgttataatactaccaatcccatgtcaacatccccgccttcccacacttcgttagcactggataccattaaacatcaattttgccaatccaaraggtgttaaatagcttccattgtttagatttgcatttctttaactgtggctgaacttaagcctttttttatgagtttattgatcattagtatttcttttt

SEQ ID NO: 120608 - DNA, 201 bp, Bos taurus
atccttggacttccctggtgggccagtggttaagactccacacttcaaatgcaggtttgatccacagtcgaggaactaagactccaaataccatatggtgyggccaaaataagaaaaaaaacaaaagcaatattctcaaaccttcatgtgaatgggttcaaatgcagactgaaaagtaaatactgtctaatactattgaat

SEQ ID NO: 120609 - DNA, 201 bp, Bos taurus; identical to SEQ ID NO: 79820

SEQ ID NO: 120610 - DNA, 201 bp, Bos taurus; identical to SEQ ID NO: 79821

SEQ ID NO: 120611 - DNA, 201 bp, Bos taurus; identical to SEQ ID NO: 79823

SEQ ID NO: 120612 - DNA, 201 bp, Bos taurus; identical to SEQ ID NO: 39498

SEQ ID NO: 120613 - DNA, 201 bp, Bos taurus; identical to SEQ ID NO: 39499

SEQ ID NO: 120614 - DNA, 201 bp, Bos taurus; identical to SEQ ID NO: 39500

SEQ ID NO: 120615 - DNA, 201 bp, Bos taurus; identical to SEQ ID NO: 39501

SEQ ID NO: 120616 - DNA, 201 bp, Bos taurus; identical to SEQ ID NO: 39502

SEQ ID NO: 120617 - DNA, 201 bp, Bos taurus; identical to SEQ ID NO: 39503

SEQ ID NO: 120618 - DNA, 201 bp, Bos taurus; identical to SEQ ID NO: 39504

SEQ ID NO: 120619 - DNA, 201 bp, Bos taurus; identical to SEQ ID NO: 39505

SEQ ID NO: 120620 - DNA, 201 bp, Bos taurus; identical to SEQ ID NO: 39506

SEQ ID NO: 120621 - DNA, 201 bp, Bos taurus; identical to SEQ ID NO: 39507

SEQ ID NO: 120622 - DNA, 201 bp, Bos taurus
ctgcaagtaactaaatgcagcaacaacctaaatgagcctgggacaggattctctcgtagagaaacaggagggaagaagagggaataggacctactgactcyttgacattggccttgtgaagcccagagcagagaaaattagccaagcccaccagatataggacttagaaagctgtgacaccagactgttggggtgttcgtt

SEQ ID NO: 120623 - DNA, 201 bp, Bos taurus
tgatgactatgaaaactccatccgcaacacaatagcaaattattttaccagcttccttcaaaacacaaacaggaaactctacaatatgaactttcctggamatttcaagaagtatgcttcccattttcaaacttaagccagccctgaaagagctgaaaagagatgtctgtgtagccagcagacagctcctgcagaggctgg

SEQ ID NO: 120624 - DNA, 201 bp, Bos taurus; identical to SEQ ID NO: 39509

SEQ ID NO: 120625 - DNA, 201 bp, Bos taurus; identical to SEQ ID NO: 39510

SEQ ID NO: 120626 - DNA, 201 bp, Bos taurus; identical to SEQ ID NO: 39511

SEQ ID NO: 120627 - DNA, 201 bp, Bos taurus; identical to SEQ ID NO: 39512

SEQ ID NO: 120628 - DNA, 201 bp, Bos taurus; identical to SEQ ID NO: 39513

SEQ ID NO: 120629 - DNA, 201 bp, Bos taurus; identical to SEQ ID NO: 39515

SEQ ID NO: 120630 - DNA, 201 bp, Bos taurus
agaggctaccatcgtccagaaggtgagctcgggctcctatggctgcagcaagggttcaagagaatggatagaaattccaaggcctcttgagatgagagtcrgaacaggcatggtatctcttctgcagcatttagtgggccaaagcaagtcatctgggagatcatgggagatcttgtcatctccacgcttcaccttactctg

SEQ ID NO: 120631 - DNA, 201 bp, Bos taurus
gctctgttataatgtcttttccagatgtttatgtcatggtttaatgagtctcataaagtgaatcgggacatgccatcatttttgttctctgaaataacttrtgtaagacttgtattatttctgtgttgagtttgtttaagattggttatttgttctttaaacatgtggatattttcctttagtactttgacaatattccag

SEQ ID NO: 120632 - DNA, 201 bp, Bos taurus; identical to SEQ ID NO: 39516

SEQ ID NO: 120633 - DNA, 201 bp, Bos taurus; identical to SEQ ID NO: 39521

SEQ ID NO: 120634 - DNA, 201 bp, Bos taurus
taacaggggcagtcttaactagcatctgtacgacaagaatgaaggaaactgacttgagtttgcactttgcatttaagaagggcctacagaaaagcttgctraccccaaatgacacccgcaccaaggtgaaaagacgacagcagtggaagaacagccgacctgaacagctgaaccaggcctgtaagaaccgcccagctcact

SEQ ID NO: 120635 - DNA, 201 bp, Bos taurus; identical to SEQ ID NO: 79841

SEQ ID NO: 120636 - DNA, 201 bp, Bos taurus; identical to SEQ ID NO: 79842

SEQ ID NO: 120637 - DNA, 201 bp, Bos taurus; identical to SEQ ID NO: 39524

SEQ ID NO: 120638 - DNA, 201 bp, Bos taurus; identical to SEQ ID NO: 39526

SEQ ID NO: 120639 - DNA, 201 bp, Bos taurus; identical to SEQ ID NO: 39527

SEQ ID NO: 120640 - DNA, 201 bp, Bos taurus; identical to SEQ ID NO: 79845

SEQ ID NO: 120641 - DNA, 201 bp, Bos taurus; identical to SEQ ID NO: 39528

SEQ ID NO: 120642 - DNA, 201 bp, Bos taurus; identical to SEQ ID NO: 39529

SEQ ID NO: 120643 - DNA, 201 bp, Bos taurus
ttgaatccatccccagggctaaggttgtaaatatgttgtgggggaggtaagagtcttgtgtgtagagtggagagtttggatatataggtttaagtagaaarggggggacccatgtcaagaaattcccccagaacatgaaaatagagataatttgaggtattatataaataaaagttgtgtgcagagatatagaaaacaact

SEQ ID NO: 120644 - DNA, 201 bp, Bos taurus
ctccaggatccctgagcgcacacgagaaagatctcagtagccagactcggaaaaggagaggaagagagggcacagcaggcacactagactctgcgttcagyggcagaggctgggctgctcctcttcctatcacattattctgcagatattccatggagtgtttgttctaaacgtcctctgatttggcagaggcaccttggc

SEQ ID NO: 120645 - DNA, 201 bp, Bos taurus
tcttagtcaccctgccgcatcccgcatataataggtgctgcaataagctctggtaagtcatcagatgaacctttgtggaatgtcttttgccttgcctttgrttgatttaccatgttctttacaacaaatatcctgccttaaagattccatgctcattctgtttgactctgtacctacccccaaacccaggtctgttacaga

SEQ ID NO: 120646 - DNA, 201 bp, Bos taurus; identical to SEQ ID NO: 39530

SEQ ID NO: 120647 - DNA, 201 bp, Bos taurus
gtgaagagcagcgggggcacttaccctttgtggggccactgttgttttagtgctcttttcattaactcaggggtggcgttttatggagagatgcgctgttmctgaagctggtgtggcccgcctctgggaggcccagcactccggtccagttagccctatggctccttacagcaggcgcttgttactctcaacctaaggact

SEQ ID NO: 120648 - DNA, 201 bp, Bos taurus
cctctcatatacattgtctatcctatacattacagaatggaaggaagagctgtagaatgacatttcagagaggacaggcgctaggacactccaggggcctkgggagcaggaagtaatatctccatttttgcattactctgttcagaagttgaattccaaggagcagtatctcatttatgccaagtgtctatctatctcttg

SEQ ID NO: 120649 - DNA, 201 bp, Bos taurus
tgtggtctgtgtgtgtgtgtgtgctgttttattgttgttgtatttaaaaaaaaaataaccgtgttgaagatttgagggccatgactcagtactaactgcaratatataaggaagggagaaatagtcttgcagacaaatgcgtgtaattgatgagactggttgtgcttccgtgaaaatgtgtcctgtcgggcctcaaggggg

SEQ ID NO: 120650 - DNA, 201 bp, Bos taurus
taaaaagtgaaaaaaaaaatttttttttaaagtgccctctgctgagtcatctcagtgtctgttctggaaaatctgtttgtcctatatcagggcctgtcacragtgaacacatcttcacttcacagcaaacagtaacacttgcctcatttaagagagaaaagaaggaaataaatttacacttatgcagaggccctagaagca

SEQ ID NO: 120651 - DNA, 201 bp, Bos taurus
gacacacagcacttgcgacttaactgggactccaaatacaacaatgaattcctattggccgtgtcctaacatgtggcctaagtatcagctgactcagctgkttagagaaagcatgaaaggagacaggcatgtggtgagagctaacacttggccaagaaagtacctgatgaactcatacacccttcctgtctcagaccacaa

SEQ ID NO: 120652 - DNA, 201 bp, Bos taurus
aaatgtgatagagaacagcaccctggaagctgggggttgatagagagtatgaagattgcatggagctgggagaacatgaattctgacaattcagagaagayaggccttgtcaaacagactgagtgaatattcaactgagacctcagaaaagccacaccttactgataacttctggtaacaaaaatttaaaacaagccttga

SEQ ID NO: 120653 - DNA, 201 bp, Bos taurus
gaatggaagctgcgctcacgggagaaggagaagcctgcactgccctcccacaaagacacccaagacgatcctacggcacttgaggattatgatgaaaatcrtcaacccctcagtccagaacccagtaaggagagctgacctaatttgtgtgcccaacaccatggtgtacggacatttaatcaacagggcacttgagagttc

SEQ ID NO: 120654 - DNA, 201 bp, Bos taurus
acttcagtcaacgcttcctctccctggactagtgtttcatcagtgcggccaacactaaatcaagaaagatggacgcacagctaaggccaagtaacagatgyggtaagaaaagtaacagaaaaactctggaactggttgcaactcaaactaggaaaatggcccaaacagagccaagagacctcttccactgtgtgtgtaaac

SEQ ID NO: 120655 - DNA, 201 bp, Bos taurus
attattaatatttaggatggcaaatatatacacgtcatttcttcacaaccattgcttcataaataaagacgtgacaccaagaccatcacctgcccctggaygcatcgggtgtttctggaggtgtggccattttctcaggcttctatagaaccattacatttggttgatcgttaaacatagtttaacataattctccatata

SEQ ID NO: 120656 - DNA, 201 bp, Bos taurus; identical to SEQ ID NO: 39532

SEQ ID NO: 120657 - DNA, 201 bp, Bos taurus
attcaaacataggcaatctaactccggggccagaaacagaattctcagggttctaaaatgctgagatatgccccagaaggcagtctgtctgcggttgtgaygctcttggtgctggccttgtgatgtgcctggacttggtggtttctgtatcccccagctgtgttcccaccctgctctggacaaccttctcccgctgacagc

SEQ ID NO: 120658 - DNA, 201 bp, Bos taurus; identical to SEQ ID NO: 39533

SEQ ID NO: 120659 - DNA, 201 bp, Bos taurus
ttatctagctccacagccaaagctgtcctcgaccacagtgggacacttgtgcaaggagagctaccatggccagtggtggaagcgggggcaaggcccagtgrgtcaggagtagtgcatgaactgagtcccgaacaaacgctggacaaggattgcaaattctgtcaaaagtgggtttgaattagctcctctatttacaagtct

SEQ ID NO: 120660 - DNA, 201 bp, Bos taurus; identical to SEQ ID NO: 39535

SEQ ID NO: 120661 - DNA, 201 bp, Bos taurus
cgacttagcagtagcagcatgtgtgtcttataggtcttagtagttaatacacttgggcttctgggccaagtctaaattattttgaaaatagataataaagrgcaacagccaagggaagggcatggctgaatctccaagaagtggctgtgacttgaggaaagtataaaagtgaaaattagaacgagtgggcattatggatgt

SEQ ID NO: 120662 - DNA, 201 bp, Bos taurus
gtccggagcagtgaaagccagactgacgtgtctgtctccaacctcaacctcgtggacaaagtcaggaggtttggcgtggccaaagtggtgaactcagggcragcccatgtccccaccttgactgaggaccagggacctctcctctgtgggcccccaggccctgcgcaggcccttgtccccagaggcctggtacccgaaggc

SEQ ID NO: 120663 - DNA, 201 bp, Bos taurus
tccagtcccccactcaagcaatgctaggttgccctagaggggtcgccagtgtcttaagtcactgtgacatccccagtacttatcatagggccaggtcagtrgaggtggtgatacaaaagggatgaaggaatgctattccctgcaagctgttacagacaagatgaagggattattgcttctttaagcaacgggcctctcctg

SEQ ID NO: 120664 - DNA, 201 bp, Bos taurus; identical to SEQ ID NO: 39537

SEQ ID NO: 120665 - DNA, 201 bp, Bos taurus; identical to SEQ ID NO: 39539

SEQ ID NO: 120666 - DNA, 201 bp, Bos taurus
actccgggagcccgtggagagtatggctcagggccgtctcatctgggcaggacgggactgggggctttacgcgactgaccccatcaggtgttggtgcaagycccctggcctgtgattggaaaaatggtaaaacttaggcagtctgatgctcagggctccatgctttatccaccgcactacttatcagaaaatgtcctgtcc

SEQ ID NO: 120667 - DNA, 201 bp, Bos taurus; identical to SEQ ID NO: 39540

SEQ ID NO: 120668 - DNA, 201 bp, Bos taurus; identical to SEQ ID NO: 39541

SEQ ID NO: 120669 - DNA, 201 bp, Bos taurus; identical to SEQ ID NO: 39542

SEQ ID NO: 120670 - DNA, 201 bp, Bos taurus
gctatgcttttcatgaaatacaaggccattacctagagtcttacataccatggggagaaactactgctcaacagcacttgtaagcaggggttaagtaggcrgttctcaggccacatccttcatgggtcacacctggagcttactacacaaggttatctttgggtagcctgtgactctagaatccagtttgagattctaagc

SEQ ID NO: 120671 - DNA, 201 bp, Bos taurus
gggctatagaaaagacaggactaacagaggcggcctgccgttttgtgtcgtgatctgttatattgttataaaaggagctaggactatgtcgctgatgtctycggccatgtattagagcagcttgttttgggagctgagccacatggaggagttcagaaataaaagaagcattgagaacaggtgtgtctttttgagtgagga

SEQ ID NO: 120672 - DNA, 201 bp, Bos taurus
gaaagcactggcattcagcccctgttggagatggtccctgccctgctctcctgcagtttcttcatctgaaaaatggccttcccttggagaggcctgaaaaygagctggagtcctataggcttgaggctatgagagcccgagcagaatcccttatggaaagcagcaaaggccagggcaggacacgctcctgagatcgagtga

SEQ ID NO: 120673 - DNA, 201 bp, Bos taurus
caatagagaggcgtgagtgagggactggacatcagggctggggggaaaaggaggatgacactcttcatccagtcagctggcaggtggacaggtgaataacygtattaatgcatgaatgagggagaaaaggaataaatgataggctgagttaagggacataaatgaccatgtataagcactgagacaccacacttaccatcc

SEQ ID NO: 120674 - DNA, 201 bp, Bos taurus
tgctcatctcccccgagtttaggtcaggcgttttttcctcctgtgttttcctgtatgtgtaacctattgaattcagatgacagctctggggggaaaggcckgttgctatctctaggtaatacttcagtaaagtgaaacctgacatagttctcttacttatattttgtttatggaggccccacttcctttggtcgaaaggct

SEQ ID NO: 120675 - DNA, 201 bp, Bos taurus; identical to SEQ ID NO: 39546

SEQ ID NO: 120676 - DNA, 201 bp, Bos taurus; identical to SEQ ID NO: 39547

SEQ ID NO: 120677 - DNA, 201 bp, Bos taurus; identical to SEQ ID NO: 39548

SEQ ID NO: 120678 - DNA, 201 bp, Bos taurus
gtatggttcttagcttctgaaatttatttaaaacctcctggtgtctgagtgggtgccttggactttgggattttatcataaagagtctctgtagtagaggkcaaccattggcacgtgataagaaggccatggtgtttctgtctgcagttgactggtgtcccataaatgtggtaaaatcccaaagttaattctctttgcaca

SEQ ID NO: 120679 - DNA, 201 bp, Bos taurus
gtggccagcacacctccctgcagctggtggcgcggggctcccaccaggtgggcacaagtggaagcaccagctgggagctctgttctgatgtgcactgacgyggccacatggagaccgcctgttcagccctgatgcccccacgcagggaggatgtcacccaactggaggacaccaggccatgggggtgtcaccaaagattgt

SEQ ID NO: 120680 - DNA, 201 bp, Bos taurus; identical to SEQ ID NO: 39552

SEQ ID NO: 120681 - DNA, 201 bp, Bos taurus
ttctcacgtctgcttatacacacacatactcacaatgtgtatatgtatttaaaatttggaatcaccatggagtcaacttcttggatttgactccatttgtratctctataggcttcatctgtaaaattggcatacggatgctatagacctcctaagactattaaactacatagttctgttgttatgtattattattgtata

SEQ ID NO: 120682 - DNA, 201 bp, Bos taurus
gggcaggcccttcgagggggtgtaaggggtactcgctttaaacctttcagcaggaggagcctaggctgtgagtccacttgagaatgtgcagggcccttgarcagagagcagtgggctggaaccacagcatgaatgtgactggctgtgcaccttttgacaagtctggcctctggacagtgactttcttgtttgcaaaaagta

SEQ ID NO: 120683 - DNA, 201 bp, Bos taurus; identical to SEQ ID NO: 39555

SEQ ID NO: 120684 - DNA, 201 bp, Bos taurus
ttacttacatcttgttttactccgacccagctttcagagcagtaaccatggtggagtcttgagcctgtcccctagtcaagctaagtggccacctctccccrtaatgtgcccttcacctgccttggctcctgtaatctgcccaaatatcttgacccagctctatatgtcactcaagcactggcccagttatcttctgggagg

SEQ ID NO: 120685 - DNA, 201 bp, Bos taurus
agttgcagttgaagcttgaagaccactggttgacagaatttcctcttagaagtcagtctttttcttaaagccttcagctgagtgtgtaaggcccatccacrttagagagagaagtgtaacttgctcaagttcactgattgaaatgttaatcccatccaaaaaatactttcacagaaatgtctagaatagtgtttgaccaaa

SEQ ID NO: 120686 - DNA, 201 bp, Bos taurus; identical to SEQ ID NO: 39556

SEQ ID NO: 120687 - DNA, 201 bp, Bos taurus
gagtaataatactgggcagccagggggaggccaggcgtttggtcctggtaggacattctcaggaattgggtttttattagagcagtgggaaaccaatgagkttttgagtggaatggcctcacaagatagaatttacattttgaatggatcctctggctgcagaggacaaatgcattggaaactagtcacagtagctgtgag

SEQ ID NO: 120688 - DNA, 201 bp, Bos taurus
ggtggcctgatcacttcatctctagacatgcaattccccacagcttttgcccacaactcttggctctaatgggctattgactcaaagttaatttggcttcyaggatatggtttgtgtgtgtgatgtacagtttgcaagaaacacagggctaattttgttttaggaaatgaagattaataaccagcagctggcccattaata

SEQ ID NO: 120689 - DNA, 201 bp, Bos taurus
ctcaagagagaaggctgaggtgaggccaactgcctactggaagtttccaggcaaaagcagaggagataaaacccaaggaggcccagggtgcaggaattttkgggggcatcccattcagtctttgactgagtcctggtttttgtgtgatgagaggaaatgacccaaggccagggggcgagccgctggtgagcgggaggctag

SEQ ID NO: 120690 - DNA, 201 bp, Bos taurus; identical to SEQ ID NO: 39559

SEQ ID NO: 120691 - DNA, 201 bp, Bos taurus; identical to SEQ ID NO: 39560

SEQ ID NO: 120692 - DNA, 201 bp, Bos taurus; identical to SEQ ID NO: 39561

SEQ ID NO: 120693 - DNA, 201 bp, Bos taurus; identical to SEQ ID NO: 39562

SEQ ID NO: 120694 - DNA, 201 bp, Bos taurus; identical to SEQ ID NO: 39563

SEQ ID NO: 120695 - DNA, 201 bp, Bos taurus; identical to SEQ ID NO: 39564

SEQ ID NO: 120696 - DNA, 201 bp, Bos taurus; identical to SEQ ID NO: 39565

SEQ ID NO: 120697 - DNA, 201 bp, Bos taurus; identical to SEQ ID NO: 39566

SEQ ID NO: 120698 - DNA, 201 bp, Bos taurus
gaggggcaaagagcaaggacacatgaagaggcatattcagccacatttgcttattttccttagagataatctaatccacactaccagctattgcacagaartcagacagcaattttagtacctattattttctctctacttcttccacttttaaggcatttcagtttcacatctttgaaaatattatcttccaaatcacaa

SEQ ID NO: 120699 - DNA, 201 bp, Bos taurus; identical to SEQ ID NO: 39568

SEQ ID NO: 120700 - DNA, 201 bp, Bos taurus; identical to SEQ ID NO: 39569

SEQ ID NO: 120701 - DNA, 201 bp, Bos taurus; identical to SEQ ID NO: 39574

SEQ ID NO: 120702 - DNA, 201 bp, Bos taurus
aactctagctatagataatacttccaggcttaagaaatagcaactgcaaatggacctttgtcagaaaagactatctatgcctgcagtcttttgacctccaygagagcgagagctgaaacatttccttagcaagagaaagcatcctgacaacctacgctaggcttgtcaccttgtgtgggaatttctccctgattcagacgc

SEQ ID NO: 120703 - DNA, 201 bp, Bos taurus; identical to SEQ ID NO: 39576

SEQ ID NO: 120704 - DNA, 201 bp, Bos taurus; identical to SEQ ID NO: 39578

SEQ ID NO: 120705 - DNA, 201 bp, Bos taurus
tcttactctatgaaaccttccctcacagccctctggatgcgtgaaaaaatgccctaagccttcctcctctgcttcccagtagcactggtacccacacttcraaccgggccaagcctcagctatcagtgcttctctggtttatcacctcttctgtcacctctaaaaagcaccacagatgtatctctatctttgaacttagaa

SEQ ID NO: 120706 - DNA, 201 bp, Bos taurus
gacttcgctggtggcaccgtagataagaatcggcctgccaatgcaggggacacaagttcaatccctggtccgggaagattccacaagccataagggcaackaagcccatgggccataactagcagaacccgggagccacaaccagagaaaccactgcaatgagaaacccacacagcacagctacagaggagcccccactag

SEQ ID NO: 120707 - DNA, 201 bp, Bos taurus; identical to SEQ ID NO: 39580

SEQ ID NO: 120708 - DNA, 201 bp, Bos taurus; identical to SEQ ID NO: 39581

SEQ ID NO: 120709 - DNA, 201 bp, Bos taurus; identical to SEQ ID NO: 39582

SEQ ID NO: 120710 - DNA, 201 bp, Bos taurus
cctcccaagcaaagtatttccttggctattcagggtggtgaagagaaaacactggcacagataaccttacaatatgccaagcccagacccagggacacacrtttaaaaagtcttacataagacttccaatttttcaacaaatgctcatttatccagtaagaaattattattggtttcctctttatcaagtacattctctat

SEQ ID NO: 120711 - DNA, 201 bp, Bos taurus
ctagcccatctcctccaaccacactgaatttccctgttgcgtaattaggctaaattctcataacatactcttctgatctttgctatcgcttaataaaatcrtaacaaaatatttgtgtacttcctcattgaatattcacctgccacattaaactgagagccttgtgaggaccacttctattttgttcgctgctatatgcct

SEQ ID NO: 120712 - DNA, 201 bp, Bos taurus; identical to SEQ ID NO: 39583

SEQ ID NO: 120713 - DNA, 201 bp, Bos taurus
tcagtggctttttgctagacacgtggtcagacaatactgacagccttgttcaataaaacaatacaacacagcttatgtctctaaggacagcatcagatcaytaggtagaaattaactgcttttcttgtctggtacctcattaaagctcaaaaataatagttgttctgactagttagcactattgcacatctctgaggatca

SEQ ID NO: 120714 - DNA, 201 bp, Bos taurus; identical to SEQ ID NO: 39584

SEQ ID NO: 120715 - DNA, 201 bp, Bos taurus; identical to SEQ ID NO: 39618

SEQ ID NO: 120716 - DNA, 201 bp, Bos taurus; identical to SEQ ID NO: 39619

SEQ ID NO: 120717 - DNA, 201 bp, Bos taurus; identical to SEQ ID NO: 39620

SEQ ID NO: 120718 - DNA, 201 bp, Bos taurus; identical to SEQ ID NO: 39621

SEQ ID NO: 120719 - DNA, 201 bp, Bos taurus; identical to SEQ ID NO: 39622

SEQ ID NO: 120720 - DNA, 201 bp, Bos taurus; identical to SEQ ID NO: 39623

SEQ ID NO: 120721 - DNA, 201 bp, Bos taurus; identical to SEQ ID NO: 39624

SEQ ID NO: 120722 - DNA, 201 bp, Bos taurus; identical to SEQ ID NO: 39625

SEQ ID NO: 120723 - DNA, 201 bp, Bos taurus; identical to SEQ ID NO: 39626

SEQ ID NO: 120724 - DNA, 201 bp, Bos taurus; identical to SEQ ID NO: 39628

SEQ ID NO: 120725 - DNA, 201 bp, Bos taurus; identical to SEQ ID NO: 39629

SEQ ID NO: 120726 - DNA, 201 bp, Bos taurus; identical to SEQ ID NO: 39630

SEQ ID NO: 120727 - DNA, 201 bp, Bos taurus; identical to SEQ ID NO: 39631

SEQ ID NO: 120728 - DNA, 201 bp, Bos taurus; identical to SEQ ID NO: 39632

SEQ ID NO: 120729 - DNA, 201 bp, Bos taurus; identical to SEQ ID NO: 39633

SEQ ID NO: 120730 - DNA, 201 bp, Bos taurus; identical to SEQ ID NO: 39634

SEQ ID NO: 120731 - DNA, 201 bp, Bos taurus; identical to SEQ ID NO: 39635

SEQ ID NO: 120732 - DNA, 201 bp, Bos taurus; identical to SEQ ID NO: 39636

SEQ ID NO: 120733 - DNA, 201 bp, Bos taurus; identical to SEQ ID NO: 39637

SEQ ID NO: 120734 - DNA, 201 bp, Bos taurus; identical to SEQ ID NO: 39638

SEQ ID NO: 120735 - DNA, 201 bp, Bos taurus; identical to SEQ ID NO: 39639

SEQ ID NO: 120736 - DNA, 201 bp, Bos taurus; identical to SEQ ID NO: 39640

SEQ ID NO: 120737 - DNA, 201 bp, Bos taurus; identical to SEQ ID NO: 39641

SEQ ID NO: 120738 - DNA, 201 bp, Bos taurus; identical to SEQ ID NO: 39642

SEQ ID NO: 120739 - DNA, 201 bp, Bos taurus; identical to SEQ ID NO: 39643

SEQ ID NO: 120740 - DNA, 201 bp, Bos taurus; identical to SEQ ID NO: 39644

SEQ ID NO: 120741 - DNA, 201 bp, Bos taurus; identical to SEQ ID NO: 39645

SEQ ID NO: 120742 - DNA, 201 bp, Bos taurus; identical to SEQ ID NO: 39646

SEQ ID NO: 120743 - DNA, 201 bp, Bos taurus; identical to SEQ ID NO: 39647

SEQ ID NO: 120744 - DNA, 201 bp, Bos taurus; identical to SEQ ID NO: 39648

SEQ ID NO: 120745 - DNA, 201 bp, Bos taurus; identical to SEQ ID NO: 39649

SEQ ID NO: 120746 - DNA, 201 bp, Bos taurus; identical to SEQ ID NO: 39650

SEQ ID NO: 120747 - DNA, 201 bp, Bos taurus
gggagcctacatatatatacactgaataagaatggcaaaaaaaaaagtgctttggattcatatatatatttgtaatgtatgtgtgtgtatttttatgtttycttgcccttattcattttggagccatctgaagtatctgggtctttgtcactttgaacacatcacatttgcttaggttagctgcatttggatgaaatcttt

SEQ ID NO: 120748 - DNA, 201 bp, Bos taurus; identical to SEQ ID NO: 39651

SEQ ID NO: 120749 - DNA, 201 bp, Bos taurus; identical to SEQ ID NO: 39652

SEQ ID NO: 120750 - DNA, 201 bp, Bos taurus; identical to SEQ ID NO: 39653

SEQ ID NO: 120751 - DNA, 201 bp, Bos taurus; identical to SEQ ID NO: 39654

SEQ ID NO: 120752 - DNA, 201 bp, Bos taurus; identical to SEQ ID NO: 39655

SEQ ID NO: 120753 - DNA, 201 bp, Bos taurus; identical to SEQ ID NO: 39656

SEQ ID NO: 120754 - DNA, 201 bp, Bos taurus; identical to SEQ ID NO: 39657

SEQ ID NO: 120755 - DNA, 201 bp, Bos taurus; identical to SEQ ID NO: 39658

SEQ ID NO: 120756 - DNA, 201 bp, Bos taurus; identical to SEQ ID NO: 39659

SEQ ID NO: 120757 - DNA, 201 bp, Bos taurus; identical to SEQ ID NO: 39660

SEQ ID NO: 120758 - DNA, 201 bp, Bos taurus; identical to SEQ ID NO: 39661

SEQ ID NO: 120759 - DNA, 201 bp, Bos taurus; identical to SEQ ID NO: 39662

SEQ ID NO: 120760 - DNA, 201 bp, Bos taurus; identical to SEQ ID NO: 39663

SEQ ID NO: 120761 - DNA, 201 bp, Bos taurus; identical to SEQ ID NO: 39664

SEQ ID NO: 120762 - DNA, 201 bp, Bos taurus; identical to SEQ ID NO: 80001

SEQ ID NO: 120763 - DNA, 201 bp, Bos taurus
caatggcagagcagggggcattgctgccctgttggatggagggggagactgagacccaaggggtcttgtgtgtcgctgatggcctggacaagccccagctrtgacacccgtgtctctcctttccctgagtttggaaggcaggtggaaggtgacaaggccttccaccagcaggcccccagctctgtgctcctgggggtggca

SEQ ID NO: 120764 - DNA, 201 bp, Bos taurus; identical to SEQ ID NO: 80003

SEQ ID NO: 120765 - DNA, 201 bp, Bos taurus; identical to SEQ ID NO: 80005

SEQ ID NO: 120766 - DNA, 201 bp, Bos taurus; identical to SEQ ID NO: 80006

SEQ ID NO: 120767 - DNA, 201 bp, Bos taurus; identical to SEQ ID NO: 80007

SEQ ID NO: 120768 - DNA, 201 bp, Bos taurus; identical to SEQ ID NO: 39742

SEQ ID NO: 120769 - DNA, 201 bp, Bos taurus; identical to SEQ ID NO: 39743

SEQ ID NO: 120770 - DNA, 201 bp, Bos taurus; identical to SEQ ID NO: 80012

SEQ ID NO: 120771 - DNA, 201 bp, Bos taurus
taaatcatcacaaacttctctggttggttttaggggtatgcttccaaaggctggagcaaaaaagccagaagatggccttgcagactctgggaacccctgcrctggaaagccacagtgactgtgtgaccaggcagtcaagcaatgaagaagaccaatgccgagaaggttatgccatgcgtgacctcagattcaggcctggag

SEQ ID NO: 120772 - DNA, 201 bp, Bos taurus; identical to SEQ ID NO: 80015

SEQ ID NO: 120773 - DNA, 201 bp, Bos taurus
ctggggtagtacctgaaatttgaatgactcaagggagtaaagtgagaagggttttatctagcctccaggctagaggagaaccccccaactgcccattcttrctctgcctttctgtgggccccctagagctgacctattcttcctgacaccatgcccccttccttgtgtcctggtctcaggccttgattaggtgatcctctt

SEQ ID NO: 120774 - DNA, 201 bp, Bos taurus
gacccctttctgtcccttctgagaagtccctcggtgtctctctagattactagttctctaaaccgaggccctggcactgacagatggagagggccacctcyggtgagactgacttagagaaacctaggtctgatgaggaatttccctcagaatacatgcttctttgctgaggcctcagagcttctctagaggggcacgact

SEQ ID NO: 120775 - DNA, 201 bp, Bos taurus; identical to SEQ ID NO: 80016

SEQ ID NO: 120776 - DNA, 201 bp, Bos taurus; identical to SEQ ID NO: 80017

SEQ ID NO: 120777 - DNA, 201 bp, Bos taurus
gatacacccacagtggaagcagatgaccaaaagggtagaaatgtggaggctaattcttttgaatttggggctcttggcggaaataaaacaaacacaggcarggattctcctattactgaaatggctaccaagatgacagacgtgagttgccaagaccaaatcccgggggcaggatttgttccttcagtcctggctgaggag

SEQ ID NO: 120778 - DNA, 201 bp, Bos taurus
taaccataaaagcaggaaaaagggaaggtggccctggcaccaatggttgacctcataaagggacatcaccatctgtgtcaaacccctctacccccacccayggcctgtcgttatgatccatctaggaacggcaagacccttggagcagaaaatgatgctaccagagctttgaacgtggccaagcggcactttaatttgcca

SEQ ID NO: 120779 - DNA, 201 bp, Bos taurus; identical to SEQ ID NO: 80018

SEQ ID NO: 120780 - DNA, 201 bp, Bos taurus; identical to SEQ ID NO: 80019

SEQ ID NO: 120781 - DNA, 201 bp, Bos taurus; identical to SEQ ID NO: 80020

SEQ ID NO: 120782 - DNA, 201 bp, Bos taurus; identical to SEQ ID NO: 80021

SEQ ID NO: 120783 - DNA, 201 bp, Bos taurus; identical to SEQ ID NO: 80022

SEQ ID NO: 120784 - DNA, 201 bp, Bos taurus
gcatcttcattgctgcacatgggctttctccagttgtgccgagtgggcttctcagtgcagtggcttcttgtggagcacggggtttaggcctcattattttkgggtttgctgaatttcaacatcaactgaattaagagattcatcagcactcttatgaaaaagttaggccatagatttgggaatgagaccctgaaaatttac

SEQ ID NO: 120785 - DNA, 201 bp, Bos taurus
cgcaaaagctctggtggtcaagaaaccatagtactggcacagacataggtaaattgaacgatggaaagactggagaggccagaaacagactcagtatctayggacacgtatatatatataaaagaggtggcactgttgatgaatgggggcatagtaggccattcagtacatagtgttaggagacatggttaagtagaaaaa

SEQ ID NO: 120786 - DNA, 201 bp, Bos taurus; identical to SEQ ID NO: 80027

SEQ ID NO: 120787 - DNA, 201 bp, Bos taurus; identical to SEQ ID NO: 80028

SEQ ID NO: 120788 - DNA, 201 bp, Bos taurus; identical to SEQ ID NO: 80029

SEQ ID NO: 120789 - DNA, 201 bp, Bos taurus
caaatcaactcagcccggcaacagtgaccaaggacctgctttgtttaaacccagcactctgagccccaggagacacgggtgcagaagggccgtctgccctycctgagctattagcacagtgcagtggacaggtgcatagacgttagcccagccccagcgggcagggggacctgcctccgagcccacggggccaggacagca

SEQ ID NO: 120790 - DNA, 201 bp, Bos taurus; identical to SEQ ID NO: 80030

SEQ ID NO: 120791 - DNA, 201 bp, Bos taurus; identical to SEQ ID NO: 39744

SEQ ID NO: 120792 - DNA, 201 bp, Bos taurus
aagccttttgcttattaagtacccagaaacataggttttaccttagggccacaaaaagtcagacatgactgagtgacttcactttcaacataggttttaargttgttgatcctagaaacagccactgtcaaacctgggatccaagctacctcagggctccaagatatgaccccagcccagaccagttaggcctgaatggaa

SEQ ID NO: 120793 - DNA, 201 bp, Bos taurus; identical to SEQ ID NO: 80032

SEQ ID NO: 120794 - DNA, 201 bp, Bos taurus; identical to SEQ ID NO: 39749

SEQ ID NO: 120795 - DNA, 201 bp, Bos taurus
cctatagtctgctcaatttggcatggtctcatcttcagcaagctggctgtcttttcctgtgggctgacagttctctagctaattgtgtcaaatttgaagaygctgtactccgcgtcctctccacactcattttagctgtcagcttcagcaagctgacatatgatcctcatcattcgtgcagccctagaaagagatgttcct

SEQ ID NO: 120796 - DNA, 201 bp, Bos taurus; identical to SEQ ID NO: 39750

SEQ ID NO: 120797 - DNA, 201 bp, Bos taurus; identical to SEQ ID NO: 39751

SEQ ID NO: 120798 - DNA, 201 bp, Bos taurus; identical to SEQ ID NO: 39755

SEQ ID NO: 120799 - DNA, 201 bp, Bos taurus; identical to SEQ ID NO: 80038

SEQ ID NO: 120800 - DNA, 201 bp, Bos taurus; identical to SEQ ID NO: 39762

SEQ ID NO: 120801 - DNA, 201 bp, Bos taurus; identical to SEQ ID NO: 39763

SEQ ID NO: 120802 - DNA, 201 bp, Bos taurus
gcggaggaaatagcaccctaggagtagaacacagctagcaacgtaggcgatacccacggaaagacaaagggtaggtggccagtcctgagggagacggttaytagacctacagcaaggattaagcttaagagtgctgttagagagacagggagaggccagtcagggcggagggaaaggccccaagttggtggtggtttgaat

SEQ ID NO: 120803 - DNA, 201 bp, Bos taurus; identical to SEQ ID NO: 39767

SEQ ID NO: 120804 - DNA, 201 bp, Bos taurus; identical to SEQ ID NO: 39768

SEQ ID NO: 120805 - DNA, 201 bp, Bos taurus
aattctatctgtattaaaaaaaaaaaagtcctgaggtcctacattagtgtctgtttgcacggaagtcctcaaaaggaagcaggggtttaatgcaaggtgtygttgctctgtcactaagtcgtgtccaactcttggcgaccccatggactgcagcatgccaggcttccctgtccttcagtatttccctgggtttgctccaac

SEQ ID NO: 120806 - DNA, 201 bp, Bos taurus; identical to SEQ ID NO: 80052

SEQ ID NO: 120807 - DNA, 201 bp, Bos taurus; identical to SEQ ID NO: 80054

SEQ ID NO: 120808 - DNA, 201 bp, Bos taurus
agggtcttttccaacaagtcagctcttcacatcaggtggccagagtattggagcttcagcttcagcatcagtctctccaatgaatattcagtttgatttcsttgacattggccctctagctattcctggaacgtaccaagcactctgctccctcagtacctttgcactgtactctgctgtctccgggttcttctttctcca

SEQ ID NO: 120809 - DNA, 201 bp, Bos taurus
ttttagtcttctgttgaaacatggattgttttttctttgtctttgtggaaccaagctccctaaacagtgttaccctatttagaatattttttacctccttkagctgttctctggttgtaaatgagagtacaaatgtggatggtgaatgaacgtcctgtagctttaagcccagccctttggatgcttttgtcttttataaaa

SEQ ID NO: 120810 - DNA, 201 bp, Bos taurus
cctgggctgggtccaggtggggtgacgcattgagtgcgtgactgtggacaagtcactcaactccactctgccttgcttcccatctgcagaatgggtataayagaaggccctccctcatgggccgctattgtgaggaataaatgtgatcatccacgtgcagctcctgggcagcctcagtaaactgtagctgttttattttcc

SEQ ID NO: 120811 - DNA, 201 bp, Bos taurus
ctgttccctgactctgtctcagggcagtcgcagatacaggcaggcctccggtccgtgagaagcagacttttcccaaagaatcatcttcacgttaacccacrtacggagagccctcacgggccccactgagacttgttactcattcactgctcacagtaatctcataagaaaggtataacttgcccatcttcccagcgtgga

SEQ ID NO: 120812 - DNA, 201 bp, Bos taurus; identical to SEQ ID NO: 80057

SEQ ID NO: 120813 - DNA, 201 bp, Bos taurus; identical to SEQ ID NO: 80061

SEQ ID NO: 120814 - DNA, 201 bp, Bos taurus
acctagtgtgggatcagggagctggccggtttagatgggttgggtgcttatggcaacggtcactatgggctcagtcagttccggaggtgaccagggttgcrtctgtggccttgctatgggactccacagtgcatgctgctcgacagccccacctcctcccaacagtcatttaagaatttcgaataaattcactgttacttg

SEQ ID NO: 120815 - DNA, 201 bp, Bos taurus
cctgatctgcttatggacatcatcatcccaataaagaaaagtacagtcacattctgaccccccaccccgctgcccggacctggtctgtgatgccggccccygaggtgcacccgcgtgaccaccgctgcttacctgaggctttgtcgccgcacaccacacagtactccaccacctggggccgctggacgtcggtcttcccca

SEQ ID NO: 120816 - DNA, 201 bp, Bos taurus
cccacacccaccggggttgggtcttgtcaaaccccactgataagtactaatgcagtgaccttgtctgcttttctgctcccgccctcttcaaagtgcacacrtgcccccattctccaaattaaactggatccctctaggggcactgatgcccacctctgctccaaaccaggtcacagaaagaaccaattcatagccttaccc

SEQ ID NO: 120817 - DNA, 201 bp, Bos taurus
agccaccttcacagccctctctatagcagacacccctggtttcccgggtcccacgcaggcgggcacgccttgtgcatggtattcaaaaggaagtgacgccrggccccacagcctcttgggctgcttgccccacaacctcgtggcctcgacagcatcagcttcagggcttatctccccctggaaagtaactgagttgccttc

SEQ ID NO: 120818 - DNA, 201 bp, Bos taurus
ctctctctctctctgctccctcttcttcctctcaccctgttttccacctgggccagaacctgggcccttccccacccagcaaaggccactcagccccacamtaagcaaagcttagtcccacctgagacctccccagggttcacgtgtcatcggctcagccccttggagaccttcgcttccctgggaggctcctgggctgac

SEQ ID NO: 120819 - DNA, 201 bp, Bos taurus
agctgagattcaaattttttttagcattatctactgcaggctttttcctgagaatagggtcatgacacaacccaggccttgtgaatcagaagggaaaacaracttgtgggaaagttgttgttagaggaaacgtccaaaaggtggcagcacttcttcatgcccacctctggttcttagggccaccaagctagagggaaaggc

SEQ ID NO: 120820 - DNA, 201 bp, Bos taurus
tctccccgcaggggtggggggcaggctcccataagtgaaccccaaggaggcttctcctgctcagattatcgggtgctggggccacttccttggcaaagggytctggtctccagggggtgctctgacatatatgcagggagaattcctaccagctctgggggtgcctccaattgcaaacatcccctcccgcctccagctggg

SEQ ID NO: 120821 - DNA, 201 bp, Bos taurus
cccctgatggcagacctggcccagcccgaatccagcgcctggaagcactctggagcgccctccagaaagcagacggtgggagtgaccctccaactctcccyggtctgctctttgaggcccctgctgtccatcttgagtttctagaggctgcccccaccccccagctccagcccagccagcccctggcccctgccttcccgc

SEQ ID NO: 120822 - DNA, 201 bp, Bos taurus
cccagtgccttcagaatgacccactgagaggcgattcaaggcccaccccccgccactgccacctccgggacgatcgggtcacacagcctgggtctgatctygctgctgccattcttggggccaacaatgctcgtttaataggtgggctgagactcctgcccaaatctccagatatgaatcatgtcatagctggaagaagct

SEQ ID NO: 120823 - DNA, 201 bp, Bos taurus
agaacacaacgggccaggcctggggagacatctcggcctgcgggcaggagagggccctgacaggcagtcctggacccctcctgccctgttcccctgggccmagagatgccgtcctcacccccagaaacgagtccatgctctctggggagagggtctggtgggcgtccgttaccacacgcattccacatacggttactgagg

SEQ ID NO: 120824 - DNA, 201 bp, Bos taurus
gatcagggcccaggcagggtcagcttcttctgaggcccgccccgtgcttggtgtgtagatggtctccatcttcctgtgtgctcacttggtctgcaggtgcyctgatgtctctgccctaatctcttctaaggacaccagtcaggttggaagatggcttagcctagtggcctcattgtaacttaaccccctctttacaggctg

SEQ ID NO: 120825 - DNA, 201 bp, Bos taurus
cagccctgctcctcctccagcctggaggcccgtcagcattttgattccagcgcccagctctccatggtttacagctccaccgtgaaacagccctgcgcccyggcacctcgagtgattcacttgctcaccagttctatatttagtgccgttgaacacctcagggccaagttttcagagagaaaaaggaggaggaatttaggg

SEQ ID NO: 120826 - DNA, 201 bp, Bos taurus
gggaggggggcgggggacccctcccgggccccaagacgtcatccacgccccacccagacgccgccttctgccggagcggagcctgaaacaccagaccccgrgggcctcaacagtaatagcaatatttaacaatttattctgatattaaataatattaatttatttaattaaacaagaacccttccacctcctcgggatccg

SEQ ID NO: 120827 - DNA, 201 bp, Bos taurus; identical to SEQ ID NO: 80063

SEQ ID NO: 120828 - DNA, 201 bp, Bos taurus; identical to SEQ ID NO: 39773

SEQ ID NO: 120829 - DNA, 201 bp, Bos taurus
agactcgcctccccatctcctgagagggcatgtaaccctggctggcccatttaacgccccctccagctctttagaaattcgagtcctccaaggcagaagcmgtgagagatgtttctgaaggcccagtgctgagaaactgcctgttttggggcttggcgatgcaatgtcagccccgggcacccaactagagaaagccgcccc

SEQ ID NO: 120830 - DNA, 201 bp, Bos taurus; identical to SEQ ID NO: 39777

SEQ ID NO: 120831 - DNA, 201 bp, Bos taurus; identical to SEQ ID NO: 39778

SEQ ID NO: 120832 - DNA, 201 bp, Bos taurus
gaggagttgtcacagtgggtagggctcagtgttaacttgaaagttggaatataacaggatcaggaggagggtcagattcaaggtcatttcaaggggcccaygcttaggatgatttgtcagtgaggagatgaaactgagatgtgagtcaaggtcagttcaaagtcaaatttgacttaaaatcggccggctgtgcttgggttc

SEQ ID NO: 120833 - DNA, 201 bp, Bos taurus; identical to SEQ ID NO: 80068

SEQ ID NO: 120834 - DNA, 201 bp, Bos taurus; identical to SEQ ID NO: 80069

SEQ ID NO: 120835 - DNA, 201 bp, Bos taurus; identical to SEQ ID NO: 80071

SEQ ID NO: 120836 - DNA, 201 bp, Bos taurus
ccttaacgttctggtttcaatgtctggggtccgcatgcttgccatcagcggctttcatctggaggggggtctgcttcctgaaacccagcttaagaacatgygtccgggctttatctgcgtcctttagggaaccaggagtttgatgattctgctatgtggcagaattatagtctaaattgtcacgagtttctcagcccaaca

SEQ ID NO: 120837 - DNA, 201 bp, Bos taurus
agtaggcctgccctggttcctgaatacatagcaaaacgagccctccacagaatgactttctgaggatgaccttggagaccatctgggcccaccgttacccrgacccgcaggctggtgtggaggggaccggagccaggacgtgctgtcggcaggctgggggcagggccccccgtccccgacccgggatcctccgtgggtgtc

SEQ ID NO: 120838 - DNA, 201 bp, Bos taurus; identical to SEQ ID NO: 39780

SEQ ID NO: 120839 - DNA, 201 bp, Bos taurus
gcgcccaccgccatgcggttctcagcccagggcctcgcccacgtgcctgctccccatggttcagagccgccctgtctgtctgtctgcgtgtctgtgtagcytccaggccactcccctgtcccgcttccgcaggaccgccgggcgcgtcctgagggggttcgggggtggtaagcggagtggtcggcatctctcctgctcgca

SEQ ID NO: 120840 - DNA, 201 bp, Bos taurus; identical to SEQ ID NO: 39786

SEQ ID NO: 120841 - DNA, 201 bp, Bos taurus; identical to SEQ ID NO: 39787

SEQ ID NO: 120842 - DNA, 201 bp, Bos taurus
taggcaaggcgtgagctaagaggccggaagaagacccgaggagctggaggagctgcagacgcatttattctcttccggctgacacagcagccgtaccagtmttctctcctgactcacgcggccgcggtcgcattcactcacgcggccgcggtcgcattcacgctgtagtctcgcctctcatggccaacccgagggacacgg

SEQ ID NO: 120843 - DNA, 201 bp, Bos taurus
agataaaataataaaatgtttttaaatgtcttttaaaaattatcaaggactgcaccaatgtcactttcctgatcttaatattgtaccacagtcatgcgacracgtaaccgctggggtaaacgaggtacacaagacatttctgtgcacaagcaacacttatttcaaaattaaaaaattttcacaatgaacaagtaactcagt

SEQ ID NO: 120844 - DNA, 201 bp, Bos taurus
tccgaaatcaccagggtgtctgagacccaacacacattaactccaccagcaacttcacctttatttctcccacccacacacaagctactctggccttcctyccacccacaaacaccccgaactcaaccagaacctttgcaaggacctcctcactgcgcacacagctgcctcacactccagggcaaaggtcagctcctggga

SEQ ID NO: 120845 - DNA, 201 bp, Bos taurus
tgacctttgatttggggccccacagatggctgtgcagggcgaaacagttttaaggggtgacattcacctccagcatgaggagtgctttcccaggcagtgcrcgacctgggcaaacacacccagggcccccatcttccagcccctgcacctgggagctgtgttctcttcacacccaccagaacctggaaatcttcacacaca

SEQ ID NO: 120846 - DNA, 201 bp, Bos taurus
tgtaggaaaaggtagcaaagtcaaccgaagagagaaggcaataccaacctgggaatctcccttaccggtggcctctgaaacagcttgaataaatgaaagcrtcaggttggtccaatcagaagctctgttgttgagtcgttttctgtgctgctcgttaccgtccccagcgggaggatctgggtttcccaggctcttcagaga

SEQ ID NO: 120847 - DNA, 201 bp, Bos taurus
cactttgcttcagaattccctgggaggctttccaaattgtcccatgcctgggcccatcttagacccgggacaccagaacctgggatacagaggcacaagcmctttggggaaagccattctggttcttctgacagttcaacccctggctgaacttggatctgtctcctgagatgccctgaatcgaaggaaaacatttttact

SEQ ID NO: 120848 - DNA, 201 bp, Bos taurus
agttgccgtatctgccaggcaggaggggtcattcctacaggaagaggctgttgaaggaatctgaggagatctagaacctcctgggaaagaaaagggttgartacaagtctcagattttgagagtggggccagggagccaacagaggcctgaggggtggggcagaggcttctctggacctcctctgcttgctgggggcctgg

SEQ ID NO: 120849 - DNA, 201 bp, Bos taurus
tggccaacggtgtcaaatgttgctgagactgcaaagagtccatttaatttagcaacacaaagatgttgaactgtttcattgtttagggttaaggattaaayggcaaatatgaaagagagatggttgcccacaactttttcaggaaacttggctctgtcaagaaatagaaaatggggcaggagtacagacagatgaagggct

SEQ ID NO: 120850 - DNA, 201 bp, Bos taurus
aatttcaagatcaccaagaggaatcaggaggtgatccatcagcattaagcaatcacgagggattctgtcggtgacagggttaagatgactataacataaaygggttacatgagatcaggtaacagaaggacttcataggaggtgaggtgtctggccgagaaaagttcagtgtaatgagaattcaggagggtttctattgca

SEQ ID NO: 120851 - DNA, 201 bp, Bos taurus
ctgctggtagaggtgcccgttcctctccagctctgttcctccacctgctttggcagccttcctccggggctccccttgagagctgccagcagggtgtgacrgggaagaaaggccaaagggaaggttagcggtttgggcgattggaggatatggggagattctgtgggtgatggcaagattagagaggttggagaggtggga

SEQ ID NO: 120852 - DNA, 201 bp, Bos taurus
gtgacaaatcctaatcacgggacacagggaccagtggccagtgacaaggccgtgacccatcaactgtgtagaaaggaattttcacagaggtgggaagtccrggtagacagacacacaggtcggccaagagagaaagagacacgccctcgtggttgtttgactcacttctgtggggcattgcttccaggttcctctcggcca

SEQ ID NO: 120853 - DNA, 201 bp, Bos taurus; identical to SEQ ID NO: 80120

SEQ ID NO: 120854 - DNA, 201 bp, Bos taurus; identical to SEQ ID NO: 80124

SEQ ID NO: 120855 - DNA, 201 bp, Bos taurus; identical to SEQ ID NO: 39826

SEQ ID NO: 120856 - DNA, 201 bp, Bos taurus
tcccaaacggctagggccatgtctgaatgtcccgttcagctgtctggggattggagtcccctcgggcagtctgacatgagccagagacaaagcctagaacmcggcagggctgggccttcctgagcttctgaaggaaatccctgtgatttttaaaatctcaccgatgttttgttgctcaatgctcctcatttctgactgaaa

SEQ ID NO: 120857 - DNA, 201 bp, Bos taurus
ggggagagggtgtgctgcttggtgacatcaccccaggaagatggcgggcttcgctactgggtccaaggagccagggcccgagccagcgccatcagagagaygccacttctgtctccagcacctgagctggggggaggaggctctttaagatctccgtgtagtaggggccgaacacctgctgattgtggtgtgtgaggctga

SEQ ID NO: 120858 - DNA, 201 bp, Bos taurus; identical to SEQ ID NO: 39829

SEQ ID NO: 120859 - DNA, 201 bp, Bos taurus
ccaaggccacccaaccagtaagtggcaggttgttgttgggctgaagccctgcccttgccttcacaccagtctgcctcctctgaggtggctggtcatcgtcraggtggtgccaggtgctagggcccggaagcaggcgagccccagtgcctggagaatgtggggagagcgggcagagggggcacctgtcctgcccaggtcccc

SEQ ID NO: 120860 - DNA, 201 bp, Bos taurus
gggacaggcccagggcacagagcttaggtctgagccttggactctgacctgagctgcccatagggctcttgagtccattctcacccccgacaccaggcctrctgcttctgagaacctggaaccaagttgggggtcgtccgaagccctgacctttgagcccagagaggggagcggtcacgttccctgaccccctcgcccagc

SEQ ID NO: 120861 - DNA, 201 bp, Bos taurus; identical to SEQ ID NO: 39832

SEQ ID NO: 120862 - DNA, 201 bp, Bos taurus; identical to SEQ ID NO: 39833

SEQ ID NO: 120863 - DNA, 201 bp, Bos taurus
ggcctgtcctgaagaataagttcaccacaaacctcagccacccctgcggggcctgccactgggccttgtccttcttggcgtcctgcagaggcctctgctcrctgagaaggtccttggtctcctctgggctgggggcagcagctgtagtgtcctgagcctccacagactgaactggactcttgagacatctggccccatcac

SEQ ID NO: 120864 - DNA, 201 bp, Bos taurus; identical to SEQ ID NO: 39835

SEQ ID NO: 120865 - DNA, 201 bp, Bos taurus
tttcctcatccctaaaccagtgcagctagtcctgtcttcagagcatcagtataaagatacctgagaccaggtgtgtgaagggcccagagcagggcctcggygtcccgttttccacgcatgctcagctgagtcctctctcacagtcagctgctgctcttcactgtggacggccctcccccagcctcaagagccatcctggaa

SEQ ID NO: 120866 - DNA, 201 bp, Bos taurus
catcactggcaggttcctagtagagcaggattatctgctaccttgggcatttacttcagacaaaatcatggaactgagctgggagaatataactcagaggraccagatctcaggtcctctttgttcctgtctggtcaaatccctgttggaatctgaagtttagaaaaccatcataaggcaaacagagagtcccacaatccc

SEQ ID NO: 120867 - DNA, 201 bp, Bos taurus; identical to SEQ ID NO: 39837

SEQ ID NO: 120868 - DNA, 201 bp, Bos taurus; identical to SEQ ID NO: 39838

SEQ ID NO: 120869 - DNA, 201 bp, Bos taurus
ttagagaagggtgggcaagacaagagagtgaggggtgggagaaggataagagaggacagggaggggtcatgggggagctctgtcctttgttccctggaggrggtcagcaggagtgagcagggactgaagacaaaactcaagggtgaccagggatgggccgacacctcctgggccaggtgtgtcctcaagcctctccccagc

SEQ ID NO: 120870 - DNA, 201 bp, Bos taurus
gggagtcccagatgcccaacaggccatgccctccacctgagcacctgcccagaccctggtgtgactgtgggggcagcattgaggagcagaaagagcaaagrtctaactaggaagccgggccctcagtttcctcatctgtaagacagagcagtcaccccttccatgcccctcctcccaggctatcttggggcaatggtaaag

SEQ ID NO: 120871 - DNA, 201 bp, Bos taurus; identical to SEQ ID NO: 39839

SEQ ID NO: 120872 - DNA, 201 bp, Bos taurus; identical to SEQ ID NO: 39840

SEQ ID NO: 120873 - DNA, 201 bp, Bos taurus; identical to SEQ ID NO: 39841

SEQ ID NO: 120874 - DNA, 201 bp, Bos taurus; identical to SEQ ID NO: 39842

SEQ ID NO: 120875 - DNA, 201 bp, Bos taurus; identical to SEQ ID NO: 80146

SEQ ID NO: 120876 - DNA, 201 bp, Bos taurus
ccacattgttaattggctgtactccaatacaaaataaaaggtttaaaaaaatagcttttgaaaagatttcaggtaatttaattggtatttctatttacttmctcagtttggtcttaaatactttatattggtgtttaaagttctccattattaggaagaaaatcaggctagtataaaggccagttgtagaaatcactaatt

SEQ ID NO: 120877 - DNA, 201 bp, Bos taurus
cttcctgtttcaccctttcttacacttctcttctttccttagctatttgtaaacagacccttgatcaatcttctttgcccaaaagccacccagtacattayaatgggatgcaccagccttctcaagttacttaattagggggaaaaaaaagtttgtatttctacttccaggggttggtggtggtgttcagtcaccaagtca

SEQ ID NO: 120878 - DNA, 201 bp, Bos taurus
tttgtaaatgttttaatttggaaatttcatctggagaagtgggagggctattatctggcttgaggattttctgtaaacttagattcccacttgttatatcyttatgtatccttgtttgtaattgatggtgcttttcaaactcaattatgtggacagattaggtgtgtcctttctgattaaaacagttcgagaattgctggt

SEQ ID NO: 120879 - DNA, 201 bp, Bos taurus; identical to SEQ ID NO: 80147

SEQ ID NO: 120880 - DNA, 201 bp, Bos taurus; identical to SEQ ID NO: 80153

SEQ ID NO: 120881 - DNA, 201 bp, Bos taurus; identical to SEQ ID NO: 39843

SEQ ID NO: 120882 - DNA, 201 bp, Bos taurus; identical to SEQ ID NO: 39844

SEQ ID NO: 120883 - DNA, 201 bp, Bos taurus; identical to SEQ ID NO: 39845

SEQ ID NO: 120884 - DNA, 201 bp, Bos taurus; identical to SEQ ID NO: 80158

SEQ ID NO: 120885 - DNA, 201 bp, Bos taurus
ctcatgccaaggaacagccattcattgttctctgaggccaaagacaatgctgccagaggtagcacactgctgtagagaagccaacgccaggattctaatamgtgaaaaacggcctagattgtgcctctgctttggaagccgtctattccttttcctgtggtttaatggcatttttagagatatgatcagtggaggcagggt

SEQ ID NO: 120886 - DNA, 201 bp, Bos taurus
aaaaccactaccactgatgcaagagcagcctctaggccggtgccctctccctaggagggttgctgctgctagaacccagcaggattctacccagagatgarcctgtagggccatacctactgcttccctcaaggtgggggcaactcctcccccatgtttttccatgctgtatctgtgtcccagcctccgcagaggctgggg

SEQ ID NO: 120887 - DNA, 201 bp, Bos taurus; identical to SEQ ID NO: 39848

SEQ ID NO: 120888 - DNA, 201 bp, Bos taurus; identical to SEQ ID NO: 39849

SEQ ID NO: 120889 - DNA, 201 bp, Bos taurus; identical to SEQ ID NO: 39850

SEQ ID NO: 120890 - DNA, 201 bp, Bos taurus; identical to SEQ ID NO: 39851

SEQ ID NO: 120891 - DNA, 201 bp, Bos taurus; identical to SEQ ID NO: 39852

SEQ ID NO: 120892 - DNA, 201 bp, Bos taurus
ggacgtccaggcagggccagctcttctccaaggaggcagcatcctctgcttaggtccagccctgcagtgattgaattatccgccctttcacttaatgagcrtctctctggactggccatgagacctgtgttcaggagagcagacatttcattagcagaattcagtggtgccgtgttgatcctggtttcctgacagttaaga

SEQ ID NO: 120893 - DNA, 201 bp, Bos taurus
gggccccccaaaccaagggacgccccacctctgtcaaattagaggagagcagaggcaaaggagcaggcaactcagagggatcacccaggtcgcatgacccrttgttggcaaagctggccaggacttaggtttccagacccccagcccagaggtttctccactagccactctccatcggccttctcgcccctgcctctgctc

SEQ ID NO: 120894 - DNA, 201 bp, Bos taurus; identical to SEQ ID NO: 39858

SEQ ID NO: 120895 - DNA, 201 bp, Bos taurus; identical to SEQ ID NO: 80175

SEQ ID NO: 120896 - DNA, 201 bp, Bos taurus
gttccatggagtgctggaggataagaggtttattatccagttgttgcaaccagagtagagatgccctggaaagttcactaaacacgtgacatagcaaggaygaaacaggaagtgacttatgctgccacccgagattgctactcttgggctcacaggcgccaccctcagggcttctgcccacccttggcaggcaccatatgg

SEQ ID NO: 120897 - DNA, 201 bp, Bos taurus
acaaagtcccccttggtgatgagggctgtaatggcggaacatgaacaggtgggggcgctcaagagaaagcggtcacgccgccccataaggcgaagcaaacmgtccagatggagatgactgatgcttaggctgagtgagcctggaataaagacatccacgtagccaacaagcagaaggggtttcctgagcagaggaagagca

SEQ ID NO: 120898 - DNA, 201 bp, Bos taurus; identical to SEQ ID NO: 80177

SEQ ID NO: 120899 - DNA, 201 bp, Bos taurus; identical to SEQ ID NO: 80178

SEQ ID NO: 120900 - DNA, 201 bp, Bos taurus; identical to SEQ ID NO: 39863

SEQ ID NO: 120901 - DNA, 201 bp, Bos taurus; identical to SEQ ID NO: 39864

SEQ ID NO: 120902 - DNA, 201 bp, Bos taurus; identical to SEQ ID NO: 39866

SEQ ID NO: 120903 - DNA, 201 bp, Bos taurus
tagtcggcccagattctaagaagctgagaccatgatcccaaggctccaggaggatttctgagggtctcacctttgtccctttgtaggagaaggtgtcaccrcagctcagtgccagggccagcctcccgtggctcatcctctgggcgctctcagcctacatgggccaccctctgtgtgccgagctcctccaggcctgctctg

SEQ ID NO: 120904 - DNA, 201 bp, Bos taurus; identical to SEQ ID NO: 39867

SEQ ID NO: 120905 - DNA, 201 bp, Bos taurus; identical to SEQ ID NO: 39868

SEQ ID NO: 120906 - DNA, 201 bp, Bos taurus
ccatcagtaggaattgttatagacatcataaaatattttaattatagaattaacacatatgagtgtggaaaatgaattattatttggggactctctgctcrgaaaaatgatcacttacccgatggcatcccactccagtattcttgcctggaaaatcccatggacagaggagcccggtaggctgcagcccatggggtcgct

SEQ ID NO: 120907 - DNA, 201 bp, Bos taurus; identical to SEQ ID NO: 39869

SEQ ID NO: 120908 - DNA, 201 bp, Bos taurus; identical to SEQ ID NO: 39870

SEQ ID NO: 120909 - DNA, 201 bp, Bos taurus; identical to SEQ ID NO: 80188

SEQ ID NO: 120910 - DNA, 201 bp, Bos taurus
acatagacaaaactagagatctcatagcttcactttaaaacttagttatgaatcagttacaatataagcttactagttcataagtaagttggaataaattmaatttgcttgctaagatgacaaaggctttattgcttgtggaaaagacttttaagatttgtatttgatcttgataaacccttaaggaggctatgaattaga

SEQ ID NO: 120911 - DNA, 201 bp, Bos taurus
aacaatggaagcttatgctccctcagttctggaggccagaagtgtgaaatgaaggtgttggcaagcttggttccttctggaggttcttcaagagtctgttycaggcctctctcccagcttctggtgggtgcaggcaatccttggaattgcttggcttagcgatctctctccgctcactcagtcatgtccaactctttgcga

SEQ ID NO: 120912 - DNA, 201 bp, Bos taurus
cacccgggtccggggtgtggaggtcctcggccccaagcccactttctggccgctgttccgagagcagctgtgtcgccgtacgtgtctcttctacaccattygggcccaagcctggagccgggacattgcggaggaccgcaagcgcctcctccagctctgtcccaggtaggtgggcagggtgcagccaaggagatacggtta

SEQ ID NO: 120913 - DNA, 201 bp, Bos taurus; identical to SEQ ID NO: 39872

SEQ ID NO: 120914 - DNA, 201 bp, Bos taurus; identical to SEQ ID NO: 39873

SEQ ID NO: 120915 - DNA, 201 bp, Bos taurus; identical to SEQ ID NO: 39874

SEQ ID NO: 120916 - DNA, 201 bp, Bos taurus; identical to SEQ ID NO: 39876

SEQ ID NO: 120917 - DNA, 201 bp, Bos taurus; identical to SEQ ID NO: 39877

SEQ ID NO: 120918 - DNA, 201 bp, Bos taurus
atgaaagcccccctccctaaccccggcagtccctggtcctcattaaagactctaatcctccagccctgctgcagattcagaggcctccatccccaggtctkaagggaaggggacaagcagtgatttctcttcccttcacccacccccaccaaccaggctgggcttgggcacctgacccagcggtcaatgggcatctgaggg

SEQ ID NO: 120919 - DNA, 201 bp, Bos taurus
gtgtgcagtgcctgtcccagtgcccctcacaaacaccttccctcagtttcctgccagactcctcctggcctcactgttccatctttcctctctccctcccrccggccacttcctcatgactgacgacctcctttagaattatctgaactcttggcccaactttgtcaaatcccccaccatcctcagccctgtcctagcttg

SEQ ID NO: 120920 - DNA, 201 bp, Bos taurus
ggggtacctctcctggcccccagtgccgggccttggggttgggttggcagcagaaagtgccaaggatctgggtcttgacaagataaatccctctccccacygtcttggccggcagaccagagccgaggcaggccgcccacccgctacaaggcaggatcctccaggggccgccaggctgaggccatcgtaaatagcttaact

SEQ ID NO: 120921 - DNA, 201 bp, Bos taurus; identical to SEQ ID NO: 80194

SEQ ID NO: 120922 - DNA, 201 bp, Bos taurus
ctccagggcactccacagagcacactttacaaacctctgaaccctgaaatcccctgaacaaacattctggggccctgccacatctgggagctccagaactrgggatgaggctgggaatgggggccagcccggtgtagggagcagggctgagaggtcccaaggtgggggtcgggttgggggcagagccagtagggggagtcc

SEQ ID NO: 120923 - DNA, 201 bp, Bos taurus
agtttcccttgggccagaggagggctggaggaccgacctgtggccagtgggatagaagccgcgtgtgtgatttccagtgagtttcccttaaagggaaggtraagggaaggggcaggcccttcttcactcttcttcctccttccctctggctggagctccagtgactggagtgaccttggaaatggaaatgacacccagcag

SEQ ID NO: 120924 - DNA, 201 bp, Bos taurus; identical to SEQ ID NO: 80195

SEQ ID NO: 120925 - DNA, 201 bp, Bos taurus; identical to SEQ ID NO: 39878

SEQ ID NO: 120926 - DNA, 201 bp, Bos taurus; identical to SEQ ID NO: 80197

SEQ ID NO: 120927 - DNA, 201 bp, Bos taurus
tccctgtggttgttcggttgccaagccctgtcctattctccttaagtaggtctttatcatagaatcttaggatggtgaccttgaaagagagattggccagyctgcagcctgttctttgagagacagaaagcaaagagagagcttctcgcttgtttagggatagtgagaagttctttttgctaacactgggaatcttcagaa

SEQ ID NO: 120928 - DNA, 201 bp, Bos taurus
tctgagggtgtttctagaagagattagcattttattttgatagaccaagtaatgtgggttggcatcattcaactcattgggggcccaaatgtaacaaaaargtcaagggagagtgaattccctttctctcttcttgagctggtatgtccatctcttcctgtcttcagatatcagagaccctggttcttgggccattggatt

SEQ ID NO: 120929 - DNA, 201 bp, Bos taurus; identical to SEQ ID NO: 80200

SEQ ID NO: 120930 - DNA, 201 bp, Bos taurus; identical to SEQ ID NO: 80201

SEQ ID NO: 120931 - DNA, 201 bp, Bos taurus
ttttccaggcaagagtactggagtggggtgccattgccttctccgaaattgcatattagtttggtgaattggaaaaatttggtgaagagtacctgggccckctctgtacatttttttgcaacttcctatgacataccaaccagtccatcctaaaggagaccagtcctgggtgttcattggaaggactgatgctgaagctga

SEQ ID NO: 120932 - DNA, 201 bp, Bos taurus; identical to SEQ ID NO: 39879

SEQ ID NO: 120933 - DNA, 201 bp, Bos taurus; identical to SEQ ID NO: 39880

SEQ ID NO: 120934 - DNA, 201 bp, Bos taurus
ggagcctctgcccccactcaagcagaggggccgggagagaggacgtgtttagggggcatcagctcttgggggctgggctttgtggagcaggctggagacargcagccctttgggggtgaggagggccatacaagactctctctttgcaaagagggtcctgagctctgagtgtttttggaaatctactcccagggtctagag

SEQ ID NO: 120935 - DNA, 201 bp, Bos taurus
cagcctgacagttcatgggatcacaaagagtcggacacaagttttagtcacagtggttttcttaaatagcagtgagagatctcactgctgtatttaaaatrgataatcaacaaggtcctactgtgcagcacagggaactctgctccatgttatgtgacagcctggatgagaggggtgtgatggcaatgagatctctcatag

SEQ ID NO: 120936 - DNA, 201 bp, Bos taurus
cacaaatgtccctatgaatcccactttgacaaggagtggcgggcggggacacagagcatcgctgggtgctggctccgtcatttcttgcctgtaaggccttrgacaagttactggaattccctgagacttagtctcctcacctagataaacgggaatccaaaatggaacctacttcaccagagtgttgagaagactctgtat

SEQ ID NO: 120937 - DNA, 201 bp, Bos taurus
ttcctaattcttcctgtttctcaattgcgttcattttccccatgaagcattgaccaagttattttgcccacaaaacccaatcccttgtaggagtttccatrtgcttatttccaatatcacacaaagtaactcatggtctttttgtctgagttttcatctattgtagtgctttacacaagccctttctctctacctggaata

SEQ ID NO: 120938 - DNA, 201 bp, Bos taurus
gacaatgttagtacttatcacagggttgtaatagatacatgatcttagacaagcttttgggagggagaagctctaacttctcttctaatgaggacattctkgaggtcaagctgtgattttctggctttccatgatgctatttcctcgagtgctgtattatgatatagacaaagttcagcacaaatctcaacatgtagagtc

SEQ ID NO: 120939 - DNA, 201 bp, Bos taurus; identical to SEQ ID NO: 39885

SEQ ID NO: 120940 - DNA, 201 bp, Bos taurus
ttgtcattgattttatgctaagagcattagtatgaagaatattattggactagatttagtatttcattctttccaaatatcaaatcccccttccttaaaayttggaagctgctacatattacctttcaatttcatttatttgtatctacagcttatgttctggactggtagcttctattctgggaacacctgctgatgtca

SEQ ID NO: 120941 - DNA, 201 bp, Bos taurus; identical to SEQ ID NO: 39887

SEQ ID NO: 120942 - DNA, 201 bp, Bos taurus; identical to SEQ ID NO: 39888

SEQ ID NO: 120943 - DNA, 201 bp, Bos taurus; identical to SEQ ID NO: 39889

SEQ ID NO: 120944 - DNA, 201 bp, Bos taurus
tggggaacttgacagctgatgtggaggatacatttgtattatttccaaccaacaagaaacttttttttagcaaatacttttaagtcaggccatccaggcaytttagttatttgtttgtttttggctgcatgtgggatcttagttcccaacccgggatggaacccacgctgccacagtggaagcatgaagccctaaccacga

SEQ ID NO: 120945 - DNA, 201 bp, Bos taurus
aagggcccattaacctgagcatttttattttcagcaatgggtagaatgttccccagggtcaaggaggtcatgctgatgatagtatgtggaaggtgcttctygaattgtcctggcccaatagacacatggcctgtgatgggactgggggtattttggggggggaattcagtttcataattgtaaccttgattgctgagattt

SEQ ID NO: 120946 - DNA, 201 bp, Bos taurus; identical to SEQ ID NO: 39890

SEQ ID NO: 120947 - DNA, 201 bp, Bos taurus; identical to SEQ ID NO: 39891

SEQ ID NO: 120948 - DNA, 201 bp, Bos taurus; identical to SEQ ID NO: 39892

SEQ ID NO: 120949 - DNA, 201 bp, Bos taurus
tgcactgcctaccttcaaagttatattccaaaggtgcaaccatttacatagcccataccctagaacctggcagagtaatctgcacatagtaggtgctctayacaatgaggctgatgaaggcccactttgggaatggtgtacctccccaaaaaagtctatgactattgagctggtcaatgcatgttttattctcagatttcc

SEQ ID NO: 120950 - DNA, 201 bp, Bos taurus; identical to SEQ ID NO: 39893

SEQ ID NO: 120951 - DNA, 201 bp, Bos taurus
tgctgtgaaaagtgtggcctgctctttgtctttctcatttatgttatgatattttcagtaattcaaaaatttaattattttttctcttttcaattgtccargaaactctaaaggagctcatatggccctcctatagggatacagctgcttaaaatggaaaggagcttctccagacagaagtttatgaagtggagtttctct

SEQ ID NO: 120952 - DNA, 201 bp, Bos taurus
ttttaatgtggaaataaatccaaagaagtttgctaaaatatagtgattcctgtatctctactcaaagatttactcagcaagtatgcattggggtctaaatktctacattttaaaactcagaagtttctgatgcaggtgagcctggggacataccatgggaacactgtgactaatataggttaatcattaaaaaaattaaag

SEQ ID NO: 120953 - DNA, 201 bp, Bos taurus
gatggagttgaaactgtcattctggaatcaaggacagaagtgaaggcagttgtcatgtgaattctgaagcttcagtgtccagagataagtctcttgggccrggaaaggacatttagagaaagaggggattaagacttcaggaagtatatgggaaagagaagcagtgtcttgttctgcaacctactcacataacctttccca

SEQ ID NO: 120954 - DNA, 201 bp, Bos taurus
aagccagcaataatcatcttaaccaactttaaatgtctgttaagtagtgtactcagggcatcttcttggatgcccccaaggccaaatgatggcatcaaatkgattacatcattctttggcagtagaagctgaaggacattgagatcatcgcagcaatacccactgccaagatgggaccagcggctctctggcctctttcaa

SEQ ID NO: 120955 - DNA, 201 bp, Bos taurus
tcattctaaagaaatgtctgaaatatctgcaagagttaagagcaagataagcactaatttaccatctccttcatccccataaggaggtacttaaaagaggrcaaaatgcatcactaggtattgtcagggtcaaactaagacttcagtatttctttgaataaaagtactatgctccactgcctaagatgaagagtgtttttg

SEQ ID NO: 120956 - DNA, 201 bp, Bos taurus
gaatgaatgtgtcattcttgataaagatgaaaacacttagacaaggagggaggagcccctgttctagactcagttttatatgcaggaacaaagatgaaccycaagatttttacctatgatgtacactccttgtataatcctctccctttgagaagggtgggcctggcctaatcaggcaaaccttttaaaagagcatgtgga

SEQ ID NO: 120957 - DNA, 201 bp, Bos taurus; identical to SEQ ID NO: 39899

SEQ ID NO: 120958 - DNA, 201 bp, Bos taurus
ggtgaggatgaagaggcgggtgactccaaatacggccgcccaggcgttgaacctgcccgcagggaggtgcagaaggtgtgtcagcctttgaggcccaaacrggaagagggttcaagggtggtcggggagggtgattgagaactgaggtgtccagaataagatgctccaggaaaaaaataaccccagggctccacctaaccc

SEQ ID NO: 120959 - DNA, 201 bp, Bos taurus; identical to SEQ ID NO: 39915

SEQ ID NO: 120960 - DNA, 201 bp, Bos taurus; identical to SEQ ID NO: 39916

SEQ ID NO: 120961 - DNA, 201 bp, Bos taurus
tgcctcagcaaaaaaaaaaaaaaaagataaaacaactgttttccaccaaattaagagtttaaaatgccagttgccaggccttccctggtggcacagtagaygggaatccgcctgtcgatggaggggacatgggatcaatccctggtctgggacgattccacaggccgcagaacaactaagcccgtgtgctgcaactacaga

SEQ ID NO: 120962 - DNA, 201 bp, Bos taurus
gtgcagtggtaaagaatttgcagctaatgccagagatgaaagagacctgggctcgatccctgatttgggaaattcccctgcagtaggagatggccaacttrctccatcattctttcctggaaaattccatggaagagaagcctgggtgggctacagtctagggggttgcagagagttggagagagagaaaagccagtgtcc

SEQ ID NO: 120963 - DNA, 201 bp, Bos taurus; identical to SEQ ID NO: 80244

SEQ ID NO: 120964 - DNA, 201 bp, Bos taurus; identical to SEQ ID NO: 39922

SEQ ID NO: 120965 - DNA, 201 bp, Bos taurus; identical to SEQ ID NO: 39923

SEQ ID NO: 120966 - DNA, 201 bp, Bos taurus; identical to SEQ ID NO: 80245

SEQ ID NO: 120967 - DNA, 201 bp, Bos taurus; identical to SEQ ID NO: 80246

SEQ ID NO: 120968 - DNA, 201 bp, Bos taurus; identical to SEQ ID NO: 39924

SEQ ID NO: 120969 - DNA, 201 bp, Bos taurus; identical to SEQ ID NO: 39925

SEQ ID NO: 120970 - DNA, 201 bp, Bos taurus; identical to SEQ ID NO: 39927

SEQ ID NO: 120971 - DNA, 201 bp, Bos taurus; identical to SEQ ID NO: 39928

SEQ ID NO: 120972 - DNA, 201 bp, Bos taurus; identical to SEQ ID NO: 80249

SEQ ID NO: 120973 - DNA, 201 bp, Bos taurus; identical to SEQ ID NO: 39931

SEQ ID NO: 120974 - DNA, 201 bp, Bos taurus
cttccaagctgtgcactctcgggcgagtcgtgtgacctatcaaagtcttcacccctaaaactggggtaaggcagtacctacttcagagggccataataagratgaaaggaaataatgtttctaaggtgcccagcacacagcagcctcagctatgatgacatgaaaagatgagcgcccgctgggaaagacagaggcacgctc

SEQ ID NO: 120975 - DNA, 201 bp, Bos taurus
ctctgagtgctgggcttatgtcctgaatccattcatttccctcagggggactagtgtttgaaacataggagccagagaggatcagcaggccctaccttctkcctcctctctccatctcaatctctccctcctcctaccatctcttacctacaacatgggcaggactatgttggacagggttctttttctagaagagactgg

SEQ ID NO: 120976 - DNA, 201 bp, Bos taurus; identical to SEQ ID NO: 39934

SEQ ID NO: 120977 - DNA, 201 bp, Bos taurus
ccgctaaccctacccgcaaggagttcacagaaagctctacttccaccttccccatgcaagtgtggtcacaaactgtcatcccagtcatcgcaatctgcaayttctctagggcccctctccccctgacggtttgcggctgcgcacataagttctttatctcctctcccttctttagaaaggtttagaggccagtttgaagtt

SEQ ID NO: 120978 - DNA, 201 bp, Bos taurus; identical to SEQ ID NO: 39935

SEQ ID NO: 120979 - DNA, 201 bp, Bos taurus; identical to SEQ ID NO: 39936

SEQ ID NO: 120980 - DNA, 201 bp, Bos taurus; identical to SEQ ID NO: 39938

SEQ ID NO: 120981 - DNA, 201 bp, Bos taurus
aggcctgaatcagaaagttttctgctcttattagtggactgagtaactcagacttcttccaggtgaagataactgaaaaagctggataaaatatttttcargtatcttaaaaattcagagggccagtaaagaatggctgggccaaagtttgcgaaaggaatctgtggatctgagcccagaacttaaaagttgcttctgtct

SEQ ID NO: 120982 - DNA, 201 bp, Bos taurus; identical to SEQ ID NO: 39940

SEQ ID NO: 120983 - DNA, 201 bp, Bos taurus
aaggtctcaataccagagaactcaggggcccaacaaccacgttctcttcacagaagcttactccacattgtgtaggtatccatgcctgtctcctccacttycagatgtcttcccggccgccccatctccccagcactgtccgtcatgcaccccaagagctccgtcatgtctcggaggtcctctctctttcccctccacagt

SEQ ID NO: 120984 - DNA, 201 bp, Bos taurus; identical to SEQ ID NO: 39955

SEQ ID NO: 120985 - DNA, 201 bp, Bos taurus; identical to SEQ ID NO: 39956

SEQ ID NO: 120986 - DNA, 201 bp, Bos taurus
cccgaggcctctcgggtccctcctggatggtaagacagccatcagacccaggggcactaggggtgctcgtttccaaccctctgctgttctccttgggcctytgaggtccacagaacccacaaacccaggcacactgaacccctttcccacccactagcccagcaggaggaccagggatatggagaaggatgggaaaagacc

SEQ ID NO: 120987 - DNA, 201 bp, Bos taurus; identical to SEQ ID NO: 39959

SEQ ID NO: 120988 - DNA, 201 bp, Bos taurus; identical to SEQ ID NO: 39982

SEQ ID NO: 120989 - DNA, 201 bp, Bos taurus; identical to SEQ ID NO: 39983

SEQ ID NO: 120990 - DNA, 201 bp, Bos taurus; identical to SEQ ID NO: 80297

SEQ ID NO: 120991 - DNA, 201 bp, Bos taurus; identical to SEQ ID NO: 39984

SEQ ID NO: 120992 - DNA, 201 bp, Bos taurus; identical to SEQ ID NO: 39985

SEQ ID NO: 120993 - DNA, 201 bp, Bos taurus; identical to SEQ ID NO: 39986

SEQ ID NO: 120994 - DNA, 201 bp, Bos taurus; identical to SEQ ID NO: 39987

SEQ ID NO: 120995 - DNA, 201 bp, Bos taurus; identical to SEQ ID NO: 39988

SEQ ID NO: 120996 - DNA, 201 bp, Bos taurus; identical to SEQ ID NO: 39989

SEQ ID NO: 120997 - DNA, 201 bp, Bos taurus; identical to SEQ ID NO: 39990

SEQ ID NO: 120998 - DNA, 201 bp, Bos taurus
atactgagactgtccagtctcctccttttgcaacgaagtattgaaattcacacttcggtcccagtagtcctgcttgggccccatcctgcagaaaagtctgytaattaaagacgttcctgtgttagatttctaatgggaaagctgtccttcagtggctcaaaacaaaactgcacagtgaacttttatagggccttgtgtgta

SEQ ID NO: 120999 - DNA, 201 bp, Bos taurus
tttgtttatccaacccagtatcaacatatcaacagagagccaaatgagcatactttagcattttgcttttgtgtaagaatttgtactccctccatcgttcygtttagttaagaatctattcatgtgccacctctgtgctgttgagagtgcagtgaatagatacgggtctctaccttcaagtggctttcagtctatggggga

SEQ ID NO: 121000 - DNA, 201 bp, Bos taurus; identical to SEQ ID NO: 39992

SEQ ID NO: 121001 - DNA, 201 bp, Bos taurus
catccttccacttcaattcaaactcagaatttccattctcagtatttcagatgagggctcactttgaaacatatattgaatggccactgtatgctacattyttattggacagggggacaataaaagtgaatttagcatgattattcctttaaggaattcacagtgcagcaggcaaaatggccataaaaataatatgaaaat

SEQ ID NO: 121002 - DNA, 201 bp, Bos taurus; identical to SEQ ID NO: 39994

SEQ ID NO: 121003 - DNA, 201 bp, Bos taurus
cctacaggggaacccctgccaggtgttctttgcaaaatggcctgaggacctggtgagatgaggcagcccaagaccccatggattttctaagtctcagaggrgattttgcaagggccaggctgagcaggtgtctactcacccctccttttcccattctaatgaagccacagggactgggcaaccctaaaccactggtgatag

SEQ ID NO: 121004 - DNA, 201 bp, Bos taurus; identical to SEQ ID NO: 39999

SEQ ID NO: 121005 - DNA, 201 bp, Bos taurus; identical to SEQ ID NO: 40000

SEQ ID NO: 121006 - DNA, 201 bp, Bos taurus; identical to SEQ ID NO: 40002

SEQ ID NO: 121007 - DNA, 201 bp, Bos taurus; identical to SEQ ID NO: 40003

SEQ ID NO: 121008 - DNA, 201 bp, Bos taurus; identical to SEQ ID NO: 40004

SEQ ID NO: 121009 - DNA, 201 bp, Bos taurus
taccaacattaacttatcaatcctcctaacacttctgaacaagacatcaggattcttgaactcagcataaaaatgggttctgtggaatggcctagccactrccattaaataaggagggaggaggggaattaaagctaaaatcctccatttctaaactacttcttggtggcctgacctgcgcgcacacacacacacagtctt

SEQ ID NO: 121010 - DNA, 201 bp, Bos taurus
ccctatggggcctgactgcactgatatttttttaaagagcaactgccacccatgggatttcgtttctgctttactagtgcagtagtgatgtctccagggcrtcgtggtgggcaggcggcccttgctggcatcgctccgcactggttggggggcggcgctgggcagcaggggtgggggaaagtgaacaccccctccagtctc

SEQ ID NO: 121011 - DNA, 201 bp, Bos taurus
tccccttcctcagggttcatcaggtactgactctgatctcttcactggaacacaagcttgggagccctgagggaaaggccaagctataagcacagattaarctgaagctccccccaaggcactggggtgggaaaggggcggaccaggaatgctgggccaaccctgcattcttggtgacttcagcgagccctcaccctctga

SEQ ID NO: 121012 - DNA, 201 bp, Bos taurus
gccccctggatgtttcaccatcacgtgtcaggattcagggaagcacgtgtagtcgcataccaccaccaaaccacagtgctccactgtggaaaggctccagyggccagccccggcgcctgtgtgcgcatcagaatcacgcacgatgattcccaaaatacacatgctcaatccgccccaacctcctaaatcagaacctttgtg

SEQ ID NO: 121013 - DNA, 201 bp, Bos taurus; identical to SEQ ID NO: 40007

SEQ ID NO: 121014 - DNA, 201 bp, Bos taurus
aagaaacaaatgcataaacacattactgctacattaaggcaatatggaaagtatactcagaaatctcagtaaagtgacagtgtaggtttctagctttaacrtagctagtattgcacccagtaaggtcatctaggtttcccaacatcctagaaaacccacaagctgaccagcgtccaaaattcccaagtgggagtggaaaaa

SEQ ID NO: 121015 - DNA, 201 bp, Bos taurus
tcttaggctttatagtttacagtaaatgcatctcagtacagattcattcattctacactgaaagatagacatcatatgtgttggatggccatttcatttcrttgtttattgcattcatgtcattcacctattcattcattcattcaaagaatgtcctatccatgggccaggtttgttacagcaacaatacagagcaaaagc

SEQ ID NO: 121016 - DNA, 201 bp, Bos taurus
ctgggcctctgacatgttacacctacagcaaagagcatggccttggagactgattccgtgagcaattctctgtttataaggaaggcaaatccactcaatcragggagaatgaaggggacttgtgggaaggatacagagaccctccctgaacccaagggcaggaagcagagccgagcctccggaaaacggacatcacagggc

SEQ ID NO: 121017 - DNA, 201 bp, Bos taurus
ggtgtgacacagcactcacaaagcacacacagaggaacaagcaagatgcgagtgtcgggaacagaaggagacaaggcagactagagcaggtggcctgctcrgcgtagcacaggacagacaagtggaaagccatctgggctcccagagaagacgtcaaatggaaatggcctgagccagagtgttaaagccctagagctccct

SEQ ID NO: 121018 - DNA, 201 bp, Bos taurus
ttagtgtaatcggagaatgtctctttgtcccattttcactgacctcctcccaatatacacacatcgtgaggactgaaacacttctgaaaaatgctcaccarccacataaataatcagggaaggtaaaatggaatctgcaggcttaaaaggttaaactacttacaagaatgcttcgttgcttaataaccatttctctcatga

SEQ ID NO: 121019 - DNA, 201 bp, Bos taurus; identical to SEQ ID NO: 40009

SEQ ID NO: 121020 - DNA, 201 bp, Bos taurus; identical to SEQ ID NO: 40010

SEQ ID NO: 121021 - DNA, 201 bp, Bos taurus; identical to SEQ ID NO: 40012

SEQ ID NO: 121022 - DNA, 201 bp, Bos taurus; identical to SEQ ID NO: 40014

SEQ ID NO: 121023 - DNA, 201 bp, Bos taurus
ggggaggtcctgctcgttggttccctcctgggcctcaacttgtttggggaatcttgaacagaagcactttgaaaggggtcttgggaagaaaaatacaatcrtacagggtcatctggtggcctgagtaggggcatttaggaattgaatatctacctggaataatggttgcatggaacattattctgcatctttccaagaatg

SEQ ID NO: 121024 - DNA, 201 bp, Bos taurus
atctttctatcatggaataatgatagatacgaaataacatctatcgtgtgtcgagtgtttcactgttttcagaatcacctcttattcattatctcagtggrtcagcacaattgctccaggcggtagcaagttcatgtttcaatagccccatttttatggctcagaaagtaaacgacgggcccaaatcacatattaagtgag

SEQ ID NO: 121025 - DNA, 201 bp, Bos taurus; identical to SEQ ID NO: 40017

SEQ ID NO: 121026 - DNA, 201 bp, Bos taurus
acagaagaacaggagaattcggaaggcaatcttccaagattatggaagtcctgatcactagcgtgtgggctgactcgtaaccagacggctctgagcctggyggtctgtttattacttccatttagtcatcttgatagttgtctcatcagcctgattaggctccaggcttacttctgttttctcatcacccctactcttgct

SEQ ID NO: 121027 - DNA, 201 bp, Bos taurus; identical to SEQ ID NO: 40018

SEQ ID NO: 121028 - DNA, 201 bp, Bos taurus
tgacataggtcacaatatgctatgaagaaataattcttgctttattcttgaagaaatcattctggctttaggttttgttcctttttattaaaataaggggraaaaaacgaagtaccattacaattgacgcctttatttctacacttgatatcagttaattaaaaagcaaagtttgctgcattccttgacataaagaagcca

SEQ ID NO: 121029 - DNA, 201 bp, Bos taurus; identical to SEQ ID NO: 40019

SEQ ID NO: 121030 - DNA, 201 bp, Bos taurus; identical to SEQ ID NO: 40020

SEQ ID NO: 121031 - DNA, 201 bp, Bos taurus; identical to SEQ ID NO: 40021

SEQ ID NO: 121032 - DNA, 201 bp, Bos taurus; identical to SEQ ID NO: 40024

SEQ ID NO: 121033 - DNA, 201 bp, Bos taurus; identical to SEQ ID NO: 40025

SEQ ID NO: 121034 - DNA, 201 bp, Bos taurus
atatttactcagagccggattcataccctacttaactccataggaattcgcaacagttggtcttgacaactccagcagttctgagcttcattaacctattygcaggtgctctgctttccaagctgcctgtgctcagagaaaaaaaaaacaaaaaacaacactttcaaaattctctgacacagcctgccgcctcagttcagg

SEQ ID NO: 121035 - DNA, 201 bp, Bos taurus; identical to SEQ ID NO: 40032

SEQ ID NO: 121036 - DNA, 201 bp, Bos taurus
acaaaacttcaccttgtcaagaaaccacatccttgactgagttaaattaggcaccaattaagcaacagggctatctttccataccccagcacaaggccaakcgtccttttgatgatctgttaataaggaagactggaaaacaaagagccctgtgtgactgatccattcattccccaggccccacggctgtgggagtcagcc

SEQ ID NO: 121037 - DNA, 201 bp, Bos taurus; identical to SEQ ID NO: 40034

SEQ ID NO: 121038 - DNA, 201 bp, Bos taurus; identical to SEQ ID NO: 40043

SEQ ID NO: 121039 - DNA, 201 bp, Bos taurus; identical to SEQ ID NO: 40044

SEQ ID NO: 121040 - DNA, 201 bp, Bos taurus; identical to SEQ ID NO: 40045

SEQ ID NO: 121041 - DNA, 201 bp, Bos taurus; identical to SEQ ID NO: 40048

SEQ ID NO: 121042 - DNA, 201 bp, Bos taurus
caatgggatattagatgagacgccaacttgaacccacgcttgccagacagactgccatgggtgtggaagtaaaggcgcagtgagctagcacagaggaaaaygaaatacgcatctgagtcgtccgcaaactgcctttaattgtgagctatcatccatccaagcttacgacttaccccattcactctactcgggcttgtgctc

SEQ ID NO: 121043 - DNA, 201 bp, Bos taurus; identical to SEQ ID NO: 40051

SEQ ID NO: 121044 - DNA, 201 bp, Bos taurus; identical to SEQ ID NO: 40052

SEQ ID NO: 121045 - DNA, 201 bp, Bos taurus; identical to SEQ ID NO: 40053

SEQ ID NO: 121046 - DNA, 201 bp, Bos taurus
ctccagtattcttgcctggagaattccacggacagaggagcctgagggagccttggctcccacagttgatggggtcgcaaagagtcggacataactgagcractaacattttcagatgttttttagatcatccactccttgctgtaggactgttgcccaagttcaccttgtctgtagctcttgaccacctgttgacatctt

SEQ ID NO: 121047 - DNA, 201 bp, Bos taurus; identical to SEQ ID NO: 40054

SEQ ID NO: 121048 - DNA, 201 bp, Bos taurus; identical to SEQ ID NO: 40058

SEQ ID NO: 121049 - DNA, 201 bp, Bos taurus; identical to SEQ ID NO: 40059

SEQ ID NO: 121050 - DNA, 201 bp, Bos taurus
aatgacatagggaaaccaggtccgagcaggcggaccgagccacgcccgcagagctgtggacagccgccctgcaacgggacacacgtgaaggaccctcacargctgtttgctcccggacctcgcggtgctcacactccattttctcgacatggcctgtgacggaaggactgtccatgtgtcagaagcaaacagctcggcaac

SEQ ID NO: 121051 - DNA, 201 bp, Bos taurus; identical to SEQ ID NO: 40065

SEQ ID NO: 121052 - DNA, 201 bp, Bos taurus; identical to SEQ ID NO: 40067

SEQ ID NO: 121053 - DNA, 201 bp, Bos taurus; identical to SEQ ID NO: 40069

SEQ ID NO: 121054 - DNA, 201 bp, Bos taurus; identical to SEQ ID NO: 40070

SEQ ID NO: 121055 - DNA, 201 bp, Bos taurus
ccattccccagggataaccggagcctgacttccacgagcttaggaggacgtggttttttatattataaacatttgaggccaaaaagagattaaaaagcaayggagatgagctttcatcgaaaacaccttgccaaatatctcaagggaaaaaacgacccattcgaagctcttacaattgatcttttgcacttcaaacactaa

SEQ ID NO: 121056 - DNA, 201 bp, Bos taurus
aagacaaccagtgtcactcagttgcttctctgcctggtgctctgcacatgtgattatctgaaaccctcaaaactgccctgtgataaagtttggcctgtgtrctgttttatagatgagcaaaacagattgtaacaatatgtgtgcataagaatctcctgagaagtttgctgctgatgaaggtgacttgaccagccaatggtg

SEQ ID NO: 121057 - DNA, 201 bp, Bos taurus; identical to SEQ ID NO: 40072

SEQ ID NO: 121058 - DNA, 201 bp, Bos taurus
ggatgagaaagttctcctggtcaccctggcagcgcggtctccctttgaacctccacaacatttagagtcaagaaaggccgtctttcggatgctgtgctgcrcaaggtatcacgcggaatcctcccaggagcctcgtgagaaaccgaggcccagagaactcaagtgactggcctcgggacgcacagcagcggccaccgggct

SEQ ID NO: 121059 - DNA, 201 bp, Bos taurus
gagaaggataagcagaaaaagaaaatgtgaagaatcatggcttcacctctacttctctttttagccgaacagcccgcacgcaccgacatggcagcactttyttctccacacatgacggtctgggagtcggaggaatgattcggtgatgggcgggactccactgggctcctctggacccatgaattcagaaggagagaaaag

SEQ ID NO: 121060 - DNA, 201 bp, Bos taurus; identical to SEQ ID NO: 40091

SEQ ID NO: 121061 - DNA, 201 bp, Bos taurus; identical to SEQ ID NO: 40092

SEQ ID NO: 121062 - DNA, 201 bp, Bos taurus; identical to SEQ ID NO: 40093

SEQ ID NO: 121063 - DNA, 201 bp, Bos taurus; identical to SEQ ID NO: 40094

SEQ ID NO: 121064 - DNA, 201 bp, Bos taurus; identical to SEQ ID NO: 40095

SEQ ID NO: 121065 - DNA, 201 bp, Bos taurus; identical to SEQ ID NO: 40096

SEQ ID NO: 121066 - DNA, 201 bp, Bos taurus; identical to SEQ ID NO: 40097

SEQ ID NO: 121067 - DNA, 201 bp, Bos taurus; identical to SEQ ID NO: 40098

SEQ ID NO: 121068 - DNA, 201 bp, Bos taurus; identical to SEQ ID NO: 40099

SEQ ID NO: 121069 - DNA, 201 bp, Bos taurus; identical to SEQ ID NO: 40106

SEQ ID NO: 121070 - DNA, 201 bp, Bos taurus
ggaaaaaacagttgattttcaacttcttgctaaacaaaatttagtccttaatcaactaaatctgaagacatagggcaagtgacccaagaaggcctgttgamaagagaccccagaaagcccagatgggacctttacttgagactcaaattgtccctgaattttgtaattaggacatggccaccacatgaatgcttagagaaa

SEQ ID NO: 121071 - DNA, 201 bp, Bos taurus
tggggccagcgttctgtgattttagctcccgagtgtccggaggctctccagacaaagggctggtgtgctacaggaaggaggctcaagtgtgtccattcccrcaaacgaaagtgcattggccctgggcgtccagcagggagccctgcccgagcctgggcaggggtcagggcagcgtcacacagactaacacccaggtcatag

SEQ ID NO: 121072 - DNA, 201 bp, Bos taurus; identical to SEQ ID NO: 80435

SEQ ID NO: 121073 - DNA, 201 bp, Bos taurus
ctccccctgtctctcaggatggacaccacgcggccagaaccacccactatggctccctgccccagaaggcgcagcacggccggccccaagacgaaaacccygtagtgcacttcttcaagaacatcgtgagtgttggcgtgggggtggggagtggaggggtgcagggcgagggtgggggagcggagaggtgaggggtgcctg

SEQ ID NO: 121074 - DNA, 201 bp, Bos taurus; identical to SEQ ID NO: 40112

SEQ ID NO: 121075 - DNA, 201 bp, Bos taurus; identical to SEQ ID NO: 80436

SEQ ID NO: 121076 - DNA, 201 bp, Bos taurus
ctgtactcagtcagcccagtgagcctggtgcccagacacccccagtagagagcccagctcgccaggccatgtgacattccacagggaacaggattcgtctygctcctcctgcctgggggccgagcatagagaaggcgacagtgctggagggactggagagttgcaggaaagaccgtgatcctcctcccgccccttgtgctc

SEQ ID NO: 121077 - DNA, 201 bp, Bos taurus
ccaggagctccctgccctctgctctgtgccctggtcttccccccgcctccgcctctcctgggggctcttactccacagaaacaccttccactttgctttcyattgcctttgatttctcatccttcctctcagtgtttgacttttctcaaacttttttcttctgttgaagactcacttagtgccacgtcgctgccccgtttc

SEQ ID NO: 121078 - DNA, 201 bp, Bos taurus
cgacaccctccctttcttgcagagtcacagtctgcggccgtgacaggtcctctgaagaatctggcactgaagagtccatttccgtcagcgtttctccatcratcccgccctgcggcccttggggtctctggggacgctgccctggggctgtggacgccagccctcgggcacagcacagggggtggctccacccggcgcccc

SEQ ID NO: 121079 - DNA, 201 bp, Bos taurus; identical to SEQ ID NO: 80439

SEQ ID NO: 121080 - DNA, 201 bp, Bos taurus; identical to SEQ ID NO: 40115

SEQ ID NO: 121081 - DNA, 201 bp, Bos taurus; identical to SEQ ID NO: 40239

SEQ ID NO: 121082 - DNA, 201 bp, Bos taurus; identical to SEQ ID NO: 40240

SEQ ID NO: 121083 - DNA, 201 bp, Bos taurus; identical to SEQ ID NO: 40241

SEQ ID NO: 121084 - DNA, 201 bp, Bos taurus; identical to SEQ ID NO: 40242

SEQ ID NO: 121085 - DNA, 201 bp, Bos taurus; identical to SEQ ID NO: 40244

SEQ ID NO: 121086 - DNA, 201 bp, Bos taurus; identical to SEQ ID NO: 40245

SEQ ID NO: 121087 - DNA, 201 bp, Bos taurus; identical to SEQ ID NO: 40246

SEQ ID NO: 121088 - DNA, 201 bp, Bos taurus; identical to SEQ ID NO: 40247

SEQ ID NO: 121089 - DNA, 201 bp, Bos taurus; identical to SEQ ID NO: 40248

SEQ ID NO: 121090 - DNA, 201 bp, Bos taurus; identical to SEQ ID NO: 40249

SEQ ID NO: 121091 - DNA, 201 bp, Bos taurus; identical to SEQ ID NO: 40250

SEQ ID NO: 121092 - DNA, 201 bp, Bos taurus; identical to SEQ ID NO: 40251

SEQ ID NO: 121093 - DNA, 201 bp, Bos taurus; identical to SEQ ID NO: 40252

SEQ ID NO: 121094 - DNA, 201 bp, Bos taurus; identical to SEQ ID NO: 40253

SEQ ID NO: 121095 - DNA, 201 bp, Bos taurus; identical to SEQ ID NO: 40254

SEQ ID NO: 121096 - DNA, 201 bp, Bos taurus; identical to SEQ ID NO: 40255

SEQ ID NO: 121097 - DNA, 201 bp, Bos taurus; identical to SEQ ID NO: 40256

SEQ ID NO: 121098 - DNA, 201 bp, Bos taurus; identical to SEQ ID NO: 40257

SEQ ID NO: 121099 - DNA, 201 bp, Bos taurus; identical to SEQ ID NO: 40258

SEQ ID NO: 121100 - DNA, 201 bp, Bos taurus; identical to SEQ ID NO: 40259

SEQ ID NO: 121101 - DNA, 201 bp, Bos taurus; identical to SEQ ID NO: 40260

SEQ ID NO: 121102 - DNA, 201 bp, Bos taurus; identical to SEQ ID NO: 40261

SEQ ID NO: 121103 - DNA, 201 bp, Bos taurus
tagagaatgtttttatttcaacccgaactgctaagaggtaaatttaagaaaatcttgaacaacaacaacaacaaaatgcaaatggaaaataaaggatccartgaagagtatctgacactctcactgttaaaaattgtatatgtattaatatactctagattaaaggtccatttaaaggcataccactaattaaatccatta

SEQ ID NO: 121104 - DNA, 201 bp, Bos taurus
aactataaatagtatgtaagctaaggtaactctcctagaatacttaaagaataagcagaaataggagtacaagtcaggtagttatagccaggtacttttayacatttatacattcttaatatatgtgtacaataatatataatgcaatgtatataaatatatatttatatataattgaattgctgttgtatacattttcat

SEQ ID NO: 121105 - DNA, 201 bp, Bos taurus
ccttttccaggggatcctcctgacccagggatcaaacccacatctcctgctttggccagtagattctttaccactgggccacctgggaagccttatatgckaatatacatgtgctgatatatatgctaatatacatgtgctgatatatatgctgctacatgggaaaaataaaaagaccagaaacttgaggccaagattatt

SEQ ID NO: 121106 - DNA, 201 bp, Bos taurus
agggggttgggcaccgggaaaacagaaccatgagtagaagcttggaattttcagctccagctgccattctcttggagggagtggggggaagaggggctgamtatgaagttaatactcaatcatgcctacattatgaagcctccataaaaagccaaaaatatggagcttgggagttttcaggttggcaaacacatccatgta

SEQ ID NO: 121107 - DNA, 201 bp, Bos taurus; identical to SEQ ID NO: 80577

SEQ ID NO: 121108 - DNA, 201 bp, Bos taurus; identical to SEQ ID NO: 80578

SEQ ID NO: 121109 - DNA, 201 bp, Bos taurus; identical to SEQ ID NO: 80579

SEQ ID NO: 121110 - DNA, 201 bp, Bos taurus; identical to SEQ ID NO: 80580

SEQ ID NO: 121111 - DNA, 201 bp, Bos taurus; identical to SEQ ID NO: 80581

SEQ ID NO: 121112 - DNA, 201 bp, Bos taurus; identical to SEQ ID NO: 80582

SEQ ID NO: 121113 - DNA, 201 bp, Bos taurus; identical to SEQ ID NO: 80583

SEQ ID NO: 121114 - DNA, 201 bp, Bos taurus; identical to SEQ ID NO: 80584

SEQ ID NO: 121115 - DNA, 201 bp, Bos taurus
tatctccagtcataggagtttgtagatacagtatttatggcattagcagggtaattattttcccattccacgatggccatggttcagatgctggtttaatragattagtcaggctgcttttagtactggagaaggctctgtcgctgttgtcaaattactgtttaatgctcaacacgaagggggcctgttggggaggactgg

SEQ ID NO: 121116 - DNA, 201 bp, Bos taurus
gctggttggactcgccactcaccgcttttaagtgcttctttttttcagactttttcttttacctccacatgaccccaaacaaatcaatcaggagccctccrgttgaaaactcttccactatatgatgtgacaccagcagaatgtctttaaaaagaaccctgtttccctctgaatgtacaataactcagagcatcagacgcg

SEQ ID NO: 121117 - DNA, 201 bp, Bos taurus
gctcctagcatgatctccataccaggcaaacattccagtatctgaactctccccgttggatgcccccgttggatctggttcttaactcggcgatccagctkcctctcaggcccctcccccacctgcattctacaggcaggcaacagagacctctacttgtagttccttatctcagcttgtaattccatgccagcgccaggc

SEQ ID NO: 121118 - DNA, 201 bp, Bos taurus
tttcccactgaacaaggtgttgtagttcttgcaaggcttaaaattttcttaccccatggtatccagttggagtgttcaaagaacgactcccaacactgctkcaagggggtctgttcattacagatccagttctgaggttcaaggcaaaatatttgcaaattgctacccataatgcacaactaacccctaagctaatttttt

SEQ ID NO: 121119 - DNA, 201 bp, Bos taurus
ccatttctagtcagggagctgggttgacaattctgcctagtttgggtctccatccaacaggccacactgactaaagagaccactctatggcctgtctgggmaaggaaggaggctcaaagcctggcttaactattgaatgtaacctctagccctgtgctactagaagcggggccagagatgcctggcagccaaggagcatgt

SEQ ID NO: 121120 - DNA, 201 bp, Bos taurus
aagtaatattttttaacctatcaaaaattagcaaaattaaaaagctaattgcatttatgttacagcattctcatgtgtccataggcctcttcttaaaaagsaactgagcagtatccctcaagctttcttgaagaaaccacactgtaacttaaaaccttgaccaattaatccctctttaggaatctattctaaggattttgt

SEQ ID NO: 121121 - DNA, 201 bp, Bos taurus
gaagtttcctgatacaaatcaattgaattaaagtaaataaaaaataaatcataattaccaaatatgagtttgtgagctaagattatttcatcatattattytggtggctcccatttcaagtagagtaaaatgtaaacagtttgtaaaactatacaatctggtccctggctagctctctgacctaatttcttgaacacatat

SEQ ID NO: 121122 - DNA, 201 bp, Bos taurus
atataaaacaaaagagagcaaaagacatagcgtgctctttaacccattggaaagctaagaaatacgaaagctaaatgaaagataagctattgctcacagargactgacatagtagttttcatccctggagggaatggaggaaggagaaataaggagaaatcacgccaaattgctgaagttttactaataaagtgtgagctg

SEQ ID NO: 121123 - DNA, 201 bp, Bos taurus; identical to SEQ ID NO: 80587

SEQ ID NO: 121124 - DNA, 201 bp, Bos taurus
gttttacttatttttgagggtgggtttgaggaatggatgaccagtgccctttaaattacaagttcctgagcagacactcagctcacatgaggccagtcccrtttggcagctcttacccattcctggtcaccaggctgccaacttgttgaccttgaaaaaatggcaccaggcctatccttctacttttgctacattctctat

SEQ ID NO: 121125 - DNA, 201 bp, Bos taurus
atgactggtgttcctataaaagggggaactgtggacaccaacccacaaaaaggaaaaataatcggaaaagaaactgggagaaggccataatgggactggarcgacccatttacgagtaacactaaaggttgcaggcatcccttctagagccatccgacagagcccggccctgctgacaccttgatctcagacccccagcct

SEQ ID NO: 121126 - DNA, 201 bp, Bos taurus
cctaatctctttcctctgatctgataagctaatccttgctaaggtacaaatggattgatgagttgcatatttgcattttaataaggaccttctggacacarggccttaaaccagagaaatggctataaagactggccatttctggtgctatgatgaattggtagggaagaaaatatagagcaggtaagtaattttccttca

SEQ ID NO: 121127 - DNA, 201 bp, Bos taurus; identical to SEQ ID NO: 40262

SEQ ID NO: 121128 - DNA, 201 bp, Bos taurus; identical to SEQ ID NO: 80590

SEQ ID NO: 121129 - DNA, 201 bp, Bos taurus; identical to SEQ ID NO: 40263

SEQ ID NO: 121130 - DNA, 201 bp, Bos taurus; identical to SEQ ID NO: 40264

SEQ ID NO: 121131 - DNA, 201 bp, Bos taurus; identical to SEQ ID NO: 40265

SEQ ID NO: 121132 - DNA, 201 bp, Bos taurus; identical to SEQ ID NO: 40266

SEQ ID NO: 121133 - DNA, 201 bp, Bos taurus
cattcctgggtcctccgtgactgtcacgtgacttcagttctaaatgagatgcagagggtcagagaatcccacactttgtaagttgggagaatcttaaagaycattttcatatgaagataaagagaatggaaagcaatgagataaacacatgtcccttgcagataccaggaatgaaatgtggagaggtggctggatggtcct

SEQ ID NO: 121134 - DNA, 201 bp, Bos taurus; identical to SEQ ID NO: 40268

SEQ ID NO: 121135 - DNA, 201 bp, Bos taurus; identical to SEQ ID NO: 80595

SEQ ID NO: 121136 - DNA, 201 bp, Bos taurus; identical to SEQ ID NO: 40272

SEQ ID NO: 121137 - DNA, 201 bp, Bos taurus; identical to SEQ ID NO: 40274

SEQ ID NO: 121138 - DNA, 201 bp, Bos taurus; identical to SEQ ID NO: 80600

SEQ ID NO: 121139 - DNA, 201 bp, Bos taurus; identical to SEQ ID NO: 40275

SEQ ID NO: 121140 - DNA, 201 bp, Bos taurus; identical to SEQ ID NO: 80607

SEQ ID NO: 121141 - DNA, 201 bp, Bos taurus; identical to SEQ ID NO: 40283

SEQ ID NO: 121142 - DNA, 201 bp, Bos taurus; identical to SEQ ID NO: 80609

SEQ ID NO: 121143 - DNA, 201 bp, Bos taurus; identical to SEQ ID NO: 80610

SEQ ID NO: 121144 - DNA, 201 bp, Bos taurus; identical to SEQ ID NO: 80611

SEQ ID NO: 121145 - DNA, 201 bp, Bos taurus; identical to SEQ ID NO: 40284

SEQ ID NO: 121146 - DNA, 201 bp, Bos taurus; identical to SEQ ID NO: 80612

SEQ ID NO: 121147 - DNA, 201 bp, Bos taurus; identical to SEQ ID NO: 40285

SEQ ID NO: 121148 - DNA, 201 bp, Bos taurus; identical to SEQ ID NO: 40287

SEQ ID NO: 121149 - DNA, 201 bp, Bos taurus; identical to SEQ ID NO: 80614

SEQ ID NO: 121150 - DNA, 201 bp, Bos taurus; identical to SEQ ID NO: 40288

SEQ ID NO: 121151 - DNA, 201 bp, Bos taurus; identical to SEQ ID NO: 40289

SEQ ID NO: 121152 - DNA, 201 bp, Bos taurus; identical to SEQ ID NO: 40290

SEQ ID NO: 121153 - DNA, 201 bp, Bos taurus; identical to SEQ ID NO: 40291

SEQ ID NO: 121154 - DNA, 201 bp, Bos taurus; identical to SEQ ID NO: 40292

SEQ ID NO: 121155 - DNA, 201 bp, Bos taurus; identical to SEQ ID NO: 40293

SEQ ID NO: 121156 - DNA, 201 bp, Bos taurus; identical to SEQ ID NO: 40294

SEQ ID NO: 121157 - DNA, 201 bp, Bos taurus; identical to SEQ ID NO: 40295

SEQ ID NO: 121158 - DNA, 201 bp, Bos taurus; identical to SEQ ID NO: 80615

SEQ ID NO: 121159 - DNA, 201 bp, Bos taurus; identical to SEQ ID NO: 40296

SEQ ID NO: 121160 - DNA, 201 bp, Bos taurus
aggaataggtggccccctcttctccttccttcttccgctctgcttcagccacaccggctccttgctctctgcgaatgtgtcaggcacattcctgacttaayggctttgcatggcctgaagctacctggaagtacttctcccaggaagccacctcacctccttccgctacttcagtgttttgagcctcctcttggtgaggtc

SEQ ID NO: 121161 - DNA, 201 bp, Bos taurus
ggaaattacatagcaccatatgttttcaggaccgttggtaatttgaaatgcacataagagatttcccaagtcaacatttattagcataatcatttattaaytgtgcaaatgacactgtccagacaccccaagtaaaatctacacagcaaaaatggcattgagtcaaactgttgttcaggagatttcagctttgaaggcaac

SEQ ID NO: 121162 - DNA, 201 bp, Bos taurus
gcaaagatctgagtgtccagtaactggtttagtgaatgctgagaggcagaaagcagattatccattttgctcctgtatgtattgtaatctcagcctggctytggagggcctcattctgatgccagaatctaaaccccagatcatagccaagacagtgtggtcttggagcagcagttggcatgaaacttcatgactcccagt

SEQ ID NO: 121163 - DNA, 201 bp, Bos taurus; identical to SEQ ID NO: 40300

SEQ ID NO: 121164 - DNA, 201 bp, Bos taurus; identical to SEQ ID NO: 40301

SEQ ID NO: 121165 - DNA, 201 bp, Bos taurus; identical to SEQ ID NO: 40302

SEQ ID NO: 121166 - DNA, 201 bp, Bos taurus; identical to SEQ ID NO: 40303

SEQ ID NO: 121167 - DNA, 201 bp, Bos taurus; identical to SEQ ID NO: 40304

SEQ ID NO: 121168 - DNA, 201 bp, Bos taurus; identical to SEQ ID NO: 40305

SEQ ID NO: 121169 - DNA, 201 bp, Bos taurus; identical to SEQ ID NO: 80627

SEQ ID NO: 121170 - DNA, 201 bp, Bos taurus
aaggaatggggaagagggcccagaagtgaggacgctcgccaggatgcgaatccgagagtaattgagtgacctggaccaagacggtggtgtgttgatctgaracgtgccagacagatggcctggagtttggggaagaaataaggcatttgatttttggatgtgccgaagtagaaggaccgcttgtaccccagagtggaaact

SEQ ID NO: 121171 - DNA, 201 bp, Bos taurus; identical to SEQ ID NO: 40306

SEQ ID NO: 121172 - DNA, 201 bp, Bos taurus; identical to SEQ ID NO: 40307

SEQ ID NO: 121173 - DNA, 201 bp, Bos taurus; identical to SEQ ID NO: 40309

SEQ ID NO: 121174 - DNA, 201 bp, Bos taurus; identical to SEQ ID NO: 40310

SEQ ID NO: 121175 - DNA, 201 bp, Bos taurus; identical to SEQ ID NO: 40311

SEQ ID NO: 121176 - DNA, 201 bp, Bos taurus; identical to SEQ ID NO: 40312

SEQ ID NO: 121177 - DNA, 201 bp, Bos taurus; identical to SEQ ID NO: 40313

SEQ ID NO: 121178 - DNA, 201 bp, Bos taurus; identical to SEQ ID NO: 40314

SEQ ID NO: 121179 - DNA, 201 bp, Bos taurus
aataatattggcaagtttgaataatatttgtcattgtaggtagagcaacagaactttgtttttcagagcaggacgaagcaaatatatcacaaaagtgaaaytgccgaatttaagatgagttgaatcctactgtactcaagcaatttatccctcccttatttcatataaaaatgtgatttcattaactgatcacagatttca

SEQ ID NO: 121180 - DNA, 201 bp, Bos taurus; identical to SEQ ID NO: 40319

SEQ ID NO: 121181 - DNA, 201 bp, Bos taurus
acacacacacagtaaaagaaaatatttttgtatctatagcatatgaaaattttaaaaaactatctaaaaccatacatttctgcttcagtttattctccttmtgaataaagtctaagtattataactagtcatttatcaaaatattagcatttcatgatgaataacttagatttgatgcacaaatatgatagaatcctgaat

SEQ ID NO: 121182 - DNA, 201 bp, Bos taurus
atttgtaatctatcatatcaggtacaattatatgtgcatataaatatgtataagagtgtactgcatgaatactgagagtataattccttaacttttattargcatgaacctagggcatgcctaaattaaatccatattatgaaataatatgcagcagttaagtacagtgacatagagacacaggcactgaacatggaaaga

SEQ ID NO: 121183 - DNA, 201 bp, Bos taurus; identical to SEQ ID NO: 80636

SEQ ID NO: 121184 - DNA, 201 bp, Bos taurus; identical to SEQ ID NO: 80638

SEQ ID NO: 121185 - DNA, 201 bp, Bos taurus; identical to SEQ ID NO: 80639

SEQ ID NO: 121186 - DNA, 201 bp, Bos taurus; identical to SEQ ID NO: 40322

SEQ ID NO: 121187 - DNA, 201 bp, Bos taurus; identical to SEQ ID NO: 80640

SEQ ID NO: 121188 - DNA, 201 bp, Bos taurus; identical to SEQ ID NO: 40323

SEQ ID NO: 121189 - DNA, 201 bp, Bos taurus; identical to SEQ ID NO: 40324

SEQ ID NO: 121190 - DNA, 201 bp, Bos taurus
ctattatcatcttgtactcaccacgttttcatcttcttagtcccaagcagctgatgtggtccctgcttctctataattcccttgtcctgataaaaataacrggccatgctctgtcaaaccctgggggatggacagtctggaccaggagagtgtaactaagctgtcaccacacacctaattggaagattcccaagtgctggg

SEQ ID NO: 121191 - DNA, 201 bp, Bos taurus; identical to SEQ ID NO: 40325

SEQ ID NO: 121192 - DNA, 201 bp, Bos taurus
catgataaatgtgacaaaaaccagtaccaaggacaaactctgtgtttcactcaaatccatcaagtgaaaaaacagtgagaccaggatgtaaacatgttagsaaacaagtggactttccttgtgtataaaaagcatttaaaagacgcttgctccttggaagaaaagctatgacaaacctagtgtattaaaaagcagagacat

SEQ ID NO: 121193 - DNA, 201 bp, Bos taurus
cctggctgtaactccacctttgttctcgctaacaaacccccagttaacctgggtttcagatggtctgtgtttgagggaaggtgggttcgtccctatcctgrgcatgaatcttgataagtctagatccattagggaattctattccgttctccaggggctggcttagataaggctcatgactcagttcttttcttaatcagt

SEQ ID NO: 121194 - DNA, 201 bp, Bos taurus; identical to SEQ ID NO: 80648

SEQ ID NO: 121195 - DNA, 201 bp, Bos taurus; identical to SEQ ID NO: 80649

SEQ ID NO: 121196 - DNA, 201 bp, Bos taurus; identical to SEQ ID NO: 40329

SEQ ID NO: 121197 - DNA, 201 bp, Bos taurus
ggccgaaatcaaggtgtttcctggccgaacattggtctggaggatctggggaagaagtcacttccaggctcatttgtgttgctggcaaattcagttgcctrtggctctggcctgaggtacccatttcctggctggcattgggcaagcagtgctctcagcttttctaagcttctctgcattccttgtcatgcccctccagct

SEQ ID NO: 121198 - DNA, 201 bp, Bos taurus; identical to SEQ ID NO: 80650

SEQ ID NO: 121199 - DNA, 201 bp, Bos taurus; identical to SEQ ID NO: 80651

SEQ ID NO: 121200 - DNA, 201 bp, Bos taurus
ttgtctatttccctgtgttctctcctgtgctgaccggcccctggcagcgaggcgtccacgaaatccgagagatcagacagttccacttcacgggctggccrgaccatggggtcccctaccacgccaccgggctgctgggctttgtccggcaggtgaagtccaagagcccacccaacgcaggccctttggtggtgcactgca

SEQ ID NO: 121201 - DNA, 201 bp, Bos taurus; identical to SEQ ID NO: 40332

SEQ ID NO: 121202 - DNA, 201 bp, Bos taurus; identical to SEQ ID NO: 40333

SEQ ID NO: 121203 - DNA, 201 bp, Bos taurus; identical to SEQ ID NO: 40334

SEQ ID NO: 121204 - DNA, 201 bp, Bos taurus; identical to SEQ ID NO: 40335

SEQ ID NO: 121205 - DNA, 201 bp, Bos taurus; identical to SEQ ID NO: 40336

SEQ ID NO: 121206 - DNA, 201 bp, Bos taurus; identical to SEQ ID NO: 80661

SEQ ID NO: 121207 - DNA, 201 bp, Bos taurus; identical to SEQ ID NO: 40346

SEQ ID NO: 121208 - DNA, 201 bp, Bos taurus; identical to SEQ ID NO: 80662

SEQ ID NO: 121209 - DNA, 201 bp, Bos taurus
ggcctgggggcatgactgctgtcccctggggctccccactgtccagctccacccccagggctttgtggttgctaccgagacccctctccccagggctgtgygtccatcactcacttcactcaggcctcgtttgggtgtcctgcctgtccagatttcctccacggcccaggacagcgagcataggacccagggagcacaggc

SEQ ID NO: 121210 - DNA, 201 bp, Bos taurus
tctgaccttaagagcacttctgcactaaaaactaaattcatcattaaaaccctgggactatggtaaacactttctgcatcttcagttctgctggatgcacrgcactgtcatcacctcacctgttgagaccattcatttaccgtttatcacagagatgggttttgaacttatgaaaataagttcgcttttaaatacttttta

SEQ ID NO: 121211 - DNA, 201 bp, Bos taurus; identical to SEQ ID NO: 40351

SEQ ID NO: 121212 - DNA, 201 bp, Bos taurus; identical to SEQ ID NO: 40352

SEQ ID NO: 121213 - DNA, 201 bp, Bos taurus; identical to SEQ ID NO: 40353

SEQ ID NO: 121214 - DNA, 201 bp, Bos taurus
gatttaatacattgccttaaaggctcttattaaaagtgaattgaattgaactgaactgaaatactgataaagaggtctgatgacagtgtcctttattcctyatctccagagtaaaacgtcctgagaactacttcttgagaacactctgtgagctacagagcagttaaaatatttaaacttgaacttggatggccatcccct

SEQ ID NO: 121215 - DNA, 201 bp, Bos taurus
cagccaggcctgctggagcagggccaggcagccccatagatcccagaccagacccagagcctttgaaatacagctgcctcttcctgggcctgctccccgcrcccctgtggtgtcatttccaaatccattacattccaatggctttgggatcttttaattacatgtgacgaagcctcgccattgctggaattagacggcctg

SEQ ID NO: 121216 - DNA, 201 bp, Bos taurus; identical to SEQ ID NO: 40358

SEQ ID NO: 121217 - DNA, 201 bp, Bos taurus
tccacagaattcctaatgtcctgtatctggagttaacaagttcccaggtggtactgacgttgctggtcctggggccatacctcgagactattatattagcmcatgtaattttcatatggcctttttaggataatgttacattataagtacatctctgtatcattagtcttcataatttttgatgactgcataatgtttaat

SEQ ID NO: 121218 - DNA, 201 bp, Bos taurus; identical to SEQ ID NO: 40364

SEQ ID NO: 121219 - DNA, 201 bp, Bos taurus; identical to SEQ ID NO: 40365

SEQ ID NO: 121220 - DNA, 201 bp, Bos taurus; identical to SEQ ID NO: 80682

SEQ ID NO: 121221 - DNA, 201 bp, Bos taurus; identical to SEQ ID NO: 80683

SEQ ID NO: 121222 - DNA, 201 bp, Bos taurus; identical to SEQ ID NO: 40370

SEQ ID NO: 121223 - DNA, 201 bp, Bos taurus; identical to SEQ ID NO: 40371

SEQ ID NO: 121224 - DNA, 201 bp, Bos taurus; identical to SEQ ID NO: 80687

SEQ ID NO: 121225 - DNA, 201 bp, Bos taurus
atcctacaggcatgtgccaatggccctcttgtgcctgatacagagttgggctcctgggtggattcaagagcaaagagatggtctccgccttgagtaactgmaacgtgatgcaaaacaggccacagagctgtgctgtggggacacacgcacacctcgggttcctggcctccagcccctctgccgggacacctgctccctcac

SEQ ID NO: 121226 - DNA, 201 bp, Bos taurus; identical to SEQ ID NO: 40376

SEQ ID NO: 121227 - DNA, 201 bp, Bos taurus; identical to SEQ ID NO: 40377

SEQ ID NO: 121228 - DNA, 201 bp, Bos taurus; identical to SEQ ID NO: 40378

SEQ ID NO: 121229 - DNA, 201 bp, Bos taurus; identical to SEQ ID NO: 40379

SEQ ID NO: 121230 - DNA, 201 bp, Bos taurus; identical to SEQ ID NO: 40380

SEQ ID NO: 121231 - DNA, 201 bp, Bos taurus; identical to SEQ ID NO: 40381

SEQ ID NO: 121232 - DNA, 201 bp, Bos taurus
acatgatcagattttaccaaaaatatcccaacagcactgtactgctctaaccaaatagtttcagtgacaatctaatctatgttttatattattttattctmaggaaatttaaaagaccataaaattttcagtaataggttttgtcattaacttcacaagtttcagatcagatctgatctgagaataaaataatataaaaca

SEQ ID NO: 121233 - DNA, 201 bp, Bos taurus; identical to SEQ ID NO: 40383

SEQ ID NO: 121234 - DNA, 201 bp, Bos taurus; identical to SEQ ID NO: 80695

SEQ ID NO: 121235 - DNA, 201 bp, Bos taurus; identical to SEQ ID NO: 40385

SEQ ID NO: 121236 - DNA, 201 bp, Bos taurus
aatgcaggaggcccagaaggtacataagaatattatgcctaaaaaaaaaaaaaaaaaaagcacatactttaatttaaaaacattttattttgaaaaaaaakgctaagcactctcttggcctttagccagttgcagtcttttggttattgggggttttactgctgactgatcagagtggtggttgcttatggtgggggtggc

SEQ ID NO: 121237 - DNA, 201 bp, Bos taurus; identical to SEQ ID NO: 40386

SEQ ID NO: 121238 - DNA, 201 bp, Bos taurus; identical to SEQ ID NO: 40387

SEQ ID NO: 121239 - DNA, 201 bp, Bos taurus
gggttgactgtttccaaatccagcatctgatcgctttaggaggccaagggctggcaggccaggggagtaaaattctttccattgcattctcatctggcctycttggagcctgggtttcttgaaaccctttcggggtccaggcagtggctctgggacctgcttgagtcaaatgtgcaccttgtgaaggccctttaggacatg

SEQ ID NO: 121240 - DNA, 201 bp, Bos taurus
ttcagcagtcatggggcgcttctggctccttctaccagcagcgacttccttccgacacacaggcttccttcccctggtcaggggccttcctgcatcaggakccctgaatgaccaccacctcctcccgccgactcctccccttctcgggacccgggagagaggggtttctaacacctgcagcccaaggcctgacccctccca

SEQ ID NO: 121241 - DNA, 201 bp, Bos taurus
ttgtttgttttctcctttctcctcagttgagttgtgagctgaaacagttagaagtgtcatagaaaccttcctttcttgtttcccaggcctaacacttaaamattttctccacttacttccttttcctgaagtttgtttattaagggaaatctctggggccagaagatgctattcagagcaaaaatgaagtatgtatttgaa

SEQ ID NO: 121242 - DNA, 201 bp, Bos taurus
cctggaggtttgggccccagtccacagagctgggcaggtactgtggccatgttggtttgtgaggtttggggacagacgtgaatgggtttctgccagctgcyggggcatctctctgctgtggccttgtcattactgtcttgcccccatccccccaaattttgaaccacaaaagcggccttaattacagctagtacccccttc

SEQ ID NO: 121243 - DNA, 201 bp, Bos taurus; identical to SEQ ID NO: 80705

SEQ ID NO: 121244 - DNA, 201 bp, Bos taurus; identical to SEQ ID NO: 40390

SEQ ID NO: 121245 - DNA, 201 bp, Bos taurus; identical to SEQ ID NO: 40391

SEQ ID NO: 121246 - DNA, 201 bp, Bos taurus; identical to SEQ ID NO: 40392

SEQ ID NO: 121247 - DNA, 201 bp, Bos taurus
tgtatatcacatcttctttctttattcatctgttgatggcaacttgggttgttctgtaccttggcaattgtaaacaatgccactatgaatggtggagtgcrtgtatctttttcaactggtgcttttgtttccttgtctcttctccaccagggggggaattgctgagtcatagtgtagttctagttttggtgctttgggaaa

SEQ ID NO: 121248 - DNA, 201 bp, Bos taurus
gctacgaagctccccagggcctcaaactcaatttctcccccagcttcttcctaaaactaaagtaaacacactggagcactgtttaccagaagcggccaacratgccccaaggagcagtatccctgaacttgtaatgctgtcagcagagaaaatgctgatgcgatatttgacacccagagttcaagggagagagcaactggg

SEQ ID NO: 121249 - DNA, 201 bp, Bos taurus
caaaaataatagaattttagaatgtgaggacctcatagatcatcacacccagtgccctgattttaaagatgagattcagagtgaggaagcgacttggccartgccatatacaacccattagttatctattgggaaacaaatgaactgaagtgagaagtgttctcacatacaggtcctcggccttactacagagtagcgtga

SEQ ID NO: 121250 - DNA, 201 bp, Bos taurus
ctgatctcctgacagtgacatcataggcttttctgcccagagtcatttataattagggctccaggtaaaaaattaacagcaggaacagatgggcccataargggcaaagagtcttttcacatggaaatttcatcagtactttaagactgaagaaaactgtagagcacaggaaggctcggccccaaaataattcttctccat

SEQ ID NO: 121251 - DNA, 201 bp, Bos taurus
atgaaagaaaaagttttaaatgtatccaaactcagataatttgtcttaaggaataaggtaaaatgaagagtctcagtactgttggcttaaaatcttctgartctcaataattcttgtgctcaaattaaatgaatggtttatattaggaaggggaaggtttacagtgggtagtgaagcttgtcaaaagtcttgaagatgtgg

SEQ ID NO: 121252 - DNA, 201 bp, Bos taurus
ggaataaaaaatattaaaaattttccattaaaaaagtagggatagaaagagtctttaaacacaaaagataagtcataagggaaaggataaaaatactgctytgaaatttagtgttttatatccccaaaatactagaagtttaagatatttataatacatacaagaaagaaaaccgtatgtccctgtaacttatttatttta

SEQ ID NO: 121253 - DNA, 201 bp, Bos taurus; identical to SEQ ID NO: 40394

SEQ ID NO: 121254 - DNA, 201 bp, Bos taurus; identical to SEQ ID NO: 40395

SEQ ID NO: 121255 - DNA, 201 bp, Bos taurus; identical to SEQ ID NO: 80713

SEQ ID NO: 121256 - DNA, 201 bp, Bos taurus
ctctgaatgaaaaagaagacaaagcattcaaatgagactgaattcaaatgcagtacttcattcagggcggccagagactgaggcctatttgggatccactygtttttttttttttttttttttgtgaaatcacttgacaactcagtcacatgaccctgcattttctgtggataaatatcctggccttcactgtgaacacta

SEQ ID NO: 121257 - DNA, 201 bp, Bos taurus
attgcaggcagactctttaccgtctgagccaccaggaaatagatttccctattctggaagtatgaacaaaatggtagaagacattgtgttttgtgactgaytttttagacttagcataatattttcaaggctcatccttgccatatgcatcagtactccatttcttcagtggtcaaatagtattccacttgtatagataga

SEQ ID NO: 121258 - DNA, 201 bp, Bos taurus; identical to SEQ ID NO: 40397

SEQ ID NO: 121259 - DNA, 201 bp, Bos taurus; identical to SEQ ID NO: 40399

SEQ ID NO: 121260 - DNA, 201 bp, Bos taurus; identical to SEQ ID NO: 40400

SEQ ID NO: 121261 - DNA, 201 bp, Bos taurus
cattagagaagctatgactacccctaaaagcttcacatttcttgcatgcttccagaatgaagcttccagaaggatcctgatgtgggccacggtgctcagcygtgcccatcccaacacaaagcatgtctggaggtgtcctcaggtgctcagtgcagaaatgagtgtgggcaaagacgaactcggtcatggccgagaacaggg

SEQ ID NO: 121262 - DNA, 201 bp, Bos taurus
cacatacacatgtgtgcatacacagtatcacaaattttgtagttctataaattatttttattcagattgttttccagtttttgaacaactacatcagacakgaataaaatctcttctccttgtaaatagcctgagaatgcattcaatacagtcacgctggttaataattgttactgtcattttgaaaacacaaaagaaaga

SEQ ID NO: 121263 - DNA, 201 bp, Bos taurus; identical to SEQ ID NO: 40401

SEQ ID NO: 121264 - DNA, 201 bp, Bos taurus; identical to SEQ ID NO: 40402

SEQ ID NO: 121265 - DNA, 201 bp, Bos taurus; identical to SEQ ID NO: 40403

SEQ ID NO: 121266 - DNA, 201 bp, Bos taurus; identical to SEQ ID NO: 80721

SEQ ID NO: 121267 - DNA, 201 bp, Bos taurus; identical to SEQ ID NO: 80724

SEQ ID NO: 121268 - DNA, 201 bp, Bos taurus
tgagtccatatcagctttgattacctctcaagcttcctgactatctccccaatctgtctactgtcccatccagcttggccaccaccttgacattaagcttyctaaaacagtaatgttctgattttccttgtccaactacaaagcctccaaggcctctaccaggaaatgctgtggactaatggacttcggagttgataacaa

SEQ ID NO: 121269 - DNA, 201 bp, Bos taurus; identical to SEQ ID NO: 40406

SEQ ID NO: 121270 - DNA, 201 bp, Bos taurus
taatgaccactatcaataaaagcatagaatagtgattgctatcaatgaaagctctcaaactgatgtactatcactgaaaaagtctgatgtgcatttttttwaatccaatttaataaaagcctagtcacaatagaaatagtggataagtgaaagaaaggacatcatttaagttggatatgtggcccagataaaatgatttga

SEQ ID NO: 121271 - DNA, 201 bp, Bos taurus
atatgctgttggactgatacaggccgatccagctgtgttttgtgttccttaaacatctcacactattcctcaaatgtttggggtttgacaaaaccccaaaygcatttggccaagcacgttttcccttgatttttaaacacatgtgggttttatgggaaatttaatccatgtgtttttgattcctttacacttaactcatca

SEQ ID NO: 121272 - DNA, 201 bp, Bos taurus
aatggtttaaagcatggcttccttcaaatagctattagtccataaaaatccttagtgcttgcaagagaatgttcaaactgatattggtgtcatgtcaaatratatatttttctactgataagggtggcccaggcaaagatagcctgacttttaatctatctcctgatcaatctgttttctccaactcaatttgagaagaga

SEQ ID NO: 121273 - DNA, 201 bp, Bos taurus; identical to SEQ ID NO: 40410

SEQ ID NO: 121274 - DNA, 201 bp, Bos taurus
actggaaaaaagaagagccttttttttgctttgcctctcaatctggtccctactggtcaaatatcgctcatgtacggacgttgtcaaagcctttggagatmgtcattattatcagtcatgatgttaatgggctgtcatcattggctgaagttgacttactctagatgctttgtttacttagctaacaaaaaggcagcttgg

SEQ ID NO: 121275 - DNA, 201 bp, Bos taurus
ggacattagcggtggccaaagtgtccccaagcacctcccttgttggcacagcaaagaacccccagtaaggagcagaaaggtggagcttcaggagctactcrgttgtcctccacttctatggccatttgcccatacagcgttgagcattcggctttagttctctccttgaatgcagggacactgggtccagactgcctggct

SEQ ID NO: 121276 - DNA, 201 bp, Bos taurus
ttagggcatgacggtcttgatgaagcgtttgaacatctccgtgtcccacaggaagaaagaacaatttccaggctgtgctgggacagaggatggggagcgtmtgaccatttttctgaaggaaacaattctgttgattggaacaggattttgcaaatgactacttcgtttttcagaggttgcagcttttaaaaatctcctaac

SEQ ID NO: 121277 - DNA, 201 bp, Bos taurus
aataggaaaagaatctcgacaagaataggaaaagaatctcccacagaaggatattgcacttcaggacttggatcaccccaaggctgtcctttcaaagcatyctcttcctttaccagtggtctctctgctttgcttggcaactcaattctctcctcgttaacaagctacgtgatgaaggctggaggtacctctgtttatttg

SEQ ID NO: 121278 - DNA, 201 bp, Bos taurus; identical to SEQ ID NO: 40414

SEQ ID NO: 121279 - DNA, 201 bp, Bos taurus; identical to SEQ ID NO: 40415

SEQ ID NO: 121280 - DNA, 201 bp, Bos taurus; identical to SEQ ID NO: 40416

SEQ ID NO: 121281 - DNA, 201 bp, Bos taurus
gatcccgtgacaccctggattctcggtgagtctgctgagtactgggaaagagaaaaaacgaaggaatcgacagctcgtttcgcgggactggtgctccggcrgaaaatggctgctttttacagacgaacgttggcaatagacttgatgatggggcgtgctgaaccccagggaagtgaaatgtagccctcctcaaaagagatt

SEQ ID NO: 121282 - DNA, 201 bp, Bos taurus; identical to SEQ ID NO: 80732

SEQ ID NO: 121283 - DNA, 201 bp, Bos taurus; identical to SEQ ID NO: 40417

SEQ ID NO: 121284 - DNA, 201 bp, Bos taurus
cttccttgcctttctagcctgtgatacggaaaatgtgagctgttctcacacacatgtgcctgaagccccaaactgcacgatgtgtgctttgggttaagtayggccctgggtaggtaccaggctctgggacagatgtaccccaaacagggagtccccgacctctgggccggtgcctgcagccctgggatgagggtgttgctc

SEQ ID NO: 121285 - DNA, 201 bp, Bos taurus; identical to SEQ ID NO: 40419

SEQ ID NO: 121286 - DNA, 201 bp, Bos taurus; identical to SEQ ID NO: 40420

SEQ ID NO: 121287 - DNA, 201 bp, Bos taurus; identical to SEQ ID NO: 40421

SEQ ID NO: 121288 - DNA, 201 bp, Bos taurus
tccattgccaccatcagatggtcatgctgattttccaagcaataaatgcttttgttgtcttgttttcagggtgaacaaaactttctgttttgttggctttygagtccctgacaaggaaggcaacacgtggggttgactctgctccgtgtcgagtgggtgctcagcgaaacactggtagttgtacttctctaaagttgtact

SEQ ID NO: 121289 - DNA, 201 bp, Bos taurus
agctccagccaacagtcaccaagggaacgtgtcagtgtgataaccaagcaagggaataacaatggcgtggccggacaggcctttcttttttttcctctgtygctgtctcacgaggcagcttctagcattttccagtacaactgtcttttggttcatttggaagttgtggccgacactggaatagtggtcagaaaacctgct

SEQ ID NO: 121290 - DNA, 201 bp, Bos taurus; identical to SEQ ID NO: 40427

SEQ ID NO: 121291 - DNA, 201 bp, Bos taurus; identical to SEQ ID NO: 80740

SEQ ID NO: 121292 - DNA, 201 bp, Bos taurus; identical to SEQ ID NO: 80741

SEQ ID NO: 121293 - DNA, 201 bp, Bos taurus
attcctcagtagagtgcattggtctactacataaagtgatagcctagctctaaaatgaaataaaatgaagaaatcttatctgtaaagccttctttttttgygttttgtttttaaactttatatcctcctttaaatgtctccccctcctcctcttttttttttttaacagcaaaggacaaggttgctcttttgataggaaat

SEQ ID NO: 121294 - DNA, 201 bp, Bos taurus
tgagtgtgactcctttctctggcctttctgagcctgaccatttcagagaacgttgctgaatagcttggttctgagcaccaggaatgagaacgtgctgactyctaacagtgggtggccctaggtaaatcttaattttcttttgtttacagggtacttggtagtaggtggctaggtaacagcacagatggagactctttccgt

SEQ ID NO: 121295 - DNA, 201 bp, Bos taurus
tggttagttgctgcgtagggattaccgaagaacccagtccctgaggatctctcctttcaggaacgcacagttccgctcactgcaaggatttctctgtcctkcgtggggccatcgcacctatcagtcctctgcgtcctgcgtggggccatcgtaccgtatcggtcctctgcctgctttcaggatcatcctgtccttcttagt

SEQ ID NO: 121296 - DNA, 201 bp, Bos taurus; identical to SEQ ID NO: 40430

SEQ ID NO: 121297 - DNA, 201 bp, Bos taurus; identical to SEQ ID NO: 40431

SEQ ID NO: 121298 - DNA, 201 bp, Bos taurus; identical to SEQ ID NO: 40432

SEQ ID NO: 121299 - DNA, 201 bp, Bos taurus; identical to SEQ ID NO: 40433

SEQ ID NO: 121300 - DNA, 201 bp, Bos taurus
ataaccaatcagcatagacgataaaatcagaatcgcaccgtttgggccctaggcttcctgtgccgggcgcgctcctggtgcccagtgacgctcctgccctyggaatctgggagctggccacctccttatctcctgttcctttgcttttgtcaggagccagcttgagtgggttatatgcgagcaaaggaaatgagaattttg

SEQ ID NO: 121301 - DNA, 201 bp, Bos taurus
tcctggcgttcaggaggacttcctgcagattggctgcgaaggtgcaacagggggagggctgaagggtgcgtcccccgcctggaggtgcgtcccccgcctgsaggcgcgtctcagggtggggatggcgctccgtgtggacattccaaacctggaggttgagtggatgttctaagagttcacttaaaaaaaaaaatcttttgt

SEQ ID NO: 121302 - DNA, 201 bp, Bos taurus; identical to SEQ ID NO: 40435

SEQ ID NO: 121303 - DNA, 201 bp, Bos taurus; identical to SEQ ID NO: 40436

SEQ ID NO: 121304 - DNA, 201 bp, Bos taurus
tattaattaaaaaacaggccacatttgcaattacaaacatagaaaaatatataaataacaaattttgaaagatttaaagaagtcagtgggttttttaagaragagaacatggaaatgtggcctccttaaaattaactgatataaaattaagaagcaagcaaatgcctagttactttcaatttttttttcttatttgaaatt

SEQ ID NO: 121305 - DNA, 201 bp, Bos taurus
atacatggaataagatcttggagaccaacatttaggtatatggtctttaaatatgcctaaactcagttgagaaacaaggaaagaaaatgaaataagcaacytgtctaatatccccgggcctcatttgttcatttctaaactggagggttgtctgttaaaatccctttcagccgttcttttggataatccaaattctctcct

SEQ ID NO: 121306 - DNA, 201 bp, Bos taurus; identical to SEQ ID NO: 40437

SEQ ID NO: 121307 - DNA, 201 bp, Bos taurus; identical to SEQ ID NO: 40440

SEQ ID NO: 121308 - DNA, 201 bp, Bos taurus; identical to SEQ ID NO: 40441

SEQ ID NO: 121309 - DNA, 201 bp, Bos taurus; identical to SEQ ID NO: 80756

SEQ ID NO: 121310 - DNA, 201 bp, Bos taurus; identical to SEQ ID NO: 40443

SEQ ID NO: 121311 - DNA, 201 bp, Bos taurus; identical to SEQ ID NO: 80759

SEQ ID NO: 121312 - DNA, 201 bp, Bos taurus; identical to SEQ ID NO: 80760

SEQ ID NO: 121313 - DNA, 201 bp, Bos taurus; identical to SEQ ID NO: 80761

SEQ ID NO: 121314 - DNA, 201 bp, Bos taurus; identical to SEQ ID NO: 40445

SEQ ID NO: 121315 - DNA, 201 bp, Bos taurus; identical to SEQ ID NO: 80762

SEQ ID NO: 121316 - DNA, 201 bp, Bos taurus; identical to SEQ ID NO: 40448

SEQ ID NO: 121317 - DNA, 201 bp, Bos taurus; identical to SEQ ID NO: 40449

SEQ ID NO: 121318 - DNA, 201 bp, Bos taurus
gggaaggcctgggacggacgccccgggactcacgtgcaccagcctgctgtccccagagcccccagggcctccgctttgaccttccgagggccttgcctttrctgcccgatgacagtttagtgcccccaggcacgcttgggcagaataactaggtgggcacccagttaatcctgccacgtgaaaggctggccggcactgagg

SEQ ID NO: 121319 - DNA, 201 bp, Bos taurus; identical to SEQ ID NO: 40451

SEQ ID NO: 121320 - DNA, 201 bp, Bos taurus; identical to SEQ ID NO: 40453

SEQ ID NO: 121321 - DNA, 201 bp, Bos taurus; identical to SEQ ID NO: 40454

SEQ ID NO: 121322 - DNA, 201 bp, Bos taurus; identical to SEQ ID NO: 40455

SEQ ID NO: 121323 - DNA, 201 bp, Bos taurus; identical to SEQ ID NO: 40457

SEQ ID NO: 121324 - DNA, 201 bp, Bos taurus; identical to SEQ ID NO: 40458

SEQ ID NO: 121325 - DNA, 201 bp, Bos taurus
caccatgcccctggcgcccccagggggatgggccccactgcagcctcagcttgcctcagggcagggggagggaggctgggcacacaggaaggccggaaggrggggcattgttagggcagaaaggctgcagcgggtgaggagggaagaagggtgggagtcacatccaggcctgcctcacaagttcccactgacgacacactg

SEQ ID NO: 121326 - DNA, 201 bp, Bos taurus; identical to SEQ ID NO: 80771

SEQ ID NO: 121327 - DNA, 201 bp, Bos taurus; identical to SEQ ID NO: 80772

SEQ ID NO: 121328 - DNA, 201 bp, Bos taurus; identical to SEQ ID NO: 40459

SEQ ID NO: 121329 - DNA, 201 bp, Bos taurus; identical to SEQ ID NO: 40460

SEQ ID NO: 121330 - DNA, 201 bp, Bos taurus
ctgggtcctctggctccccggccagccctggacacctgcaattcagctggtggttgtaaagtctcctcaaggtgcacaagagataagacctcccactcccrgggccacccagcccctccatcccatccccagccctgcaccccgacctccctgcccaagacacccactccattatcttggtgaatgtaccaggccattcac

SEQ ID NO: 121331 - DNA, 201 bp, Bos taurus; identical to SEQ ID NO: 40461

SEQ ID NO: 121332 - DNA, 201 bp, Bos taurus
gtggttgggctctgtctgggcagcacatgttctcccagctcggttccctggatccagtgggcaaacagcctgctctgtctctgccgggcttggcctcaggygagctagtaggattgtgagttcaggctgctatctcttcagaacaccccctttagcttttctgggagttctcgctctggcctcagggccttgagctactgc

SEQ ID NO: 121333 - DNA, 201 bp, Bos taurus
ctgggaggtgggggccgaggtccagaagccccacccagtagcagcctgaacactctgggtgtctacccacctcatggccactccctgagtctgtccacagkgggggatggttgagttgtccctgggggtggggattcaggggtggacctctgagctggtggcccctgtgagcctcagtctccctgtctgagcagggggctg

SEQ ID NO: 121334 - DNA, 201 bp, Bos taurus; identical to SEQ ID NO: 40464

SEQ ID NO: 121335 - DNA, 201 bp, Bos taurus
tggccgggttgggggtggtgagggcagcagggcgtcaggccccgcacagaggaaggcacgggcggcccccctgcaggcctggggggcgggagcggccagcrcgggtgccgcctctcaccagcttggtttctgtattaaacttgagattctggatggtcttgttgtcctggatgctggtttccaatttcatcatttggttct

SEQ ID NO: 121336 - DNA, 201 bp, Bos taurus
caacgagcacctggtgcagccaaataagtaaataaaagagcttaaaaatcccacaggcttcaaagcttgagaccgcaaagaatttggtgaaatgcttgcartgtgatctgatactgaggattcagaggtctaagcatctctgccgtccagcttgtgttctcctaaaagggggacactggttcacttcagagctgtctccac

SEQ ID NO: 121337 - DNA, 201 bp, Bos taurus
aggcccgaacccctcccgtcatgaacgcagaacaggccgcacgagacagcgggcgcggccgtctgtcctggtgggcacagaagcgcccaggatttcttgcygccagtgtgcatgaccaacagaacccgttatttctaacagaaagggagcatggacaagcgtcaggtgtaacaagatccaccaaataccatggagaatgag

SEQ ID NO: 121338 - DNA, 201 bp, Bos taurus
tgtagcatttgggccatgggctggtgtggaacagaactaaaacctacagcccttcgtcctctgggcttgaggtctgagccccctttgtggtttcctcacartgtgagaactcttctcataatggccctccatgcctgaatggctgctgtgtggcccacgggctgtggccaaggcacccctgccagcaggttgagggaaatg

SEQ ID NO: 121339 - DNA, 201 bp, Bos taurus
atgtgagactgaaagctccagcctttactgagtggggcgggtgagcatccatacagcaaggggaagaatgtgaacagtatttagggcatgacccagaggarctttcatgggtgcaatcaggttagtggacttcactttgaagcactgcatcaggaaggacagggataaaaagcatttctgttggcactcagctgccactca

SEQ ID NO: 121340 - DNA, 201 bp, Bos taurus
tgacatctttctgctctttttttacatgtttcagctaatatcatataagtttaatttttaggcatttttctcagttttggaaaaagggtacaagctggtartaatgttaaataattatcacactctgccaagaagagagtaaacagcaaaagcagccccccgcccccgctgtgtcgtgacaagagaccccctcaccagcac

SEQ ID NO: 121341 - DNA, 201 bp, Bos taurus; identical to SEQ ID NO: 40467

SEQ ID NO: 121342 - DNA, 201 bp, Bos taurus; identical to SEQ ID NO: 40468

SEQ ID NO: 121343 - DNA, 201 bp, Bos taurus; identical to SEQ ID NO: 40469

SEQ ID NO: 121344 - DNA, 201 bp, Bos taurus; identical to SEQ ID NO: 40470

SEQ ID NO: 121345 - DNA, 201 bp, Bos taurus; identical to SEQ ID NO: 40471

SEQ ID NO: 121346 - DNA, 201 bp, Bos taurus; identical to SEQ ID NO: 40472

SEQ ID NO: 121347 - DNA, 201 bp, Bos taurus; identical to SEQ ID NO: 40473

SEQ ID NO: 121348 - DNA, 201 bp, Bos taurus; identical to SEQ ID NO: 80779

SEQ ID NO: 121349 - DNA, 201 bp, Bos taurus; identical to SEQ ID NO: 40475

SEQ ID NO: 121350 - DNA, 201 bp, Bos taurus; identical to SEQ ID NO: 40476

SEQ ID NO: 121351 - DNA, 201 bp, Bos taurus; identical to SEQ ID NO: 40477

SEQ ID NO: 121352 - DNA, 201 bp, Bos taurus; identical to SEQ ID NO: 40478

SEQ ID NO: 121353 - DNA, 201 bp, Bos taurus
aagggccgtatgtgccaactgtgatgggcagacttctgagccagcatcacagctgagatccaggagccaggtttggggttggcagtctctctacctgcccygtttgcaagatcagaggttaggggcctccctggtgttcccgtggttaagaatccaccttgcagtgcaggggacacaggttcaatccctggtccaggaaga

SEQ ID NO: 121354 - DNA, 201 bp, Bos taurus
agctggcccagctggccttagaagggcagcagaaagatgagaataaacatggaaactttctccaagcttctcctgttcttttggtggctgctgggagtggkgggtggaggggcctggaattcatcctgggcctcctgacctggtggttctgtagcatctggtgctggaccgtcattgggtggggccaccgtctcagcttct

SEQ ID NO: 121355 - DNA, 201 bp, Bos taurus; identical to SEQ ID NO: 40480

SEQ ID NO: 121356 - DNA, 201 bp, Bos taurus; identical to SEQ ID NO: 40481

SEQ ID NO: 121357 - DNA, 201 bp, Bos taurus; identical to SEQ ID NO: 40482

SEQ ID NO: 121358 - DNA, 201 bp, Bos taurus; identical to SEQ ID NO: 40483

SEQ ID NO: 121359 - DNA, 201 bp, Bos taurus; identical to SEQ ID NO: 40484

SEQ ID NO: 121360 - DNA, 201 bp, Bos taurus; identical to SEQ ID NO: 40485

SEQ ID NO: 121361 - DNA, 201 bp, Bos taurus; identical to SEQ ID NO: 40486

SEQ ID NO: 121362 - DNA, 201 bp, Bos taurus; identical to SEQ ID NO: 40487

SEQ ID NO: 121363 - DNA, 201 bp, Bos taurus; identical to SEQ ID NO: 40488

SEQ ID NO: 121364 - DNA, 201 bp, Bos taurus; identical to SEQ ID NO: 80788

SEQ ID NO: 121365 - DNA, 201 bp, Bos taurus
caggaagtgtcagatgccctggctgggtgatcagaggtgaacactcccagtcttagggcttctcttttccttagaggggatggccccgtcgggccagcctytctccagaatgttcttgggacacctcgtgggtctctcctgcccctcccgcccactgcagccctgcccccccgcgtcagcatgggctcagccgcctcgggc

SEQ ID NO: 121366 - DNA, 201 bp, Bos taurus
cagtgggccgcgctgggcctcgtcgtctacagccacgcctcctttctttttaaccaggaaactacttcgcatcgcactttttcatgggaggtgagaaattygataccccccaccctgaaggttacctctttggagagaacatggacctgaacttcctgggcaatcgcccagtccaggtgggtctcgtgggggctgggcacg

SEQ ID NO: 121367 - DNA, 201 bp, Bos taurus
ggcaggcaagctggtccctgagtaccccaagtggtcaggatgtcagctgcagcaaaggagtcccgtccagagtcgctatttgttgcaggaagagaaacccmttccagggcccaaaagtcggctcttgtgtaacacttggaaatgaattgtccgaggagacactcctgctgacaaagcaagagacttgatcgggaaggggcg

SEQ ID NO: 121368 - DNA, 201 bp, Bos taurus; identical to SEQ ID NO: 80789

SEQ ID NO: 121369 - DNA, 201 bp, Bos taurus; identical to SEQ ID NO: 80790

SEQ ID NO: 121370 - DNA, 201 bp, Bos taurus; identical to SEQ ID NO: 40491

SEQ ID NO: 121371 - DNA, 201 bp, Bos taurus; identical to SEQ ID NO: 40495

SEQ ID NO: 121372 - DNA, 201 bp, Bos taurus
aacgtgggatcttagctccccaaccagggattgaatccgggcccttggcggtgagagtgtggagtcctaaccactagaccgctggggaactcgccagacckacagcttagaaagcccatggccaagtgcctggtgtgcagcaggatttgtggcaacatgcatgtcatgatgcatcaacactgagggctttaaaataagaat

SEQ ID NO: 121373 - DNA, 201 bp, Bos taurus
cccgcaaaacaggagcaagctggctgaggggcgcttgtcagaatttgcagagatgagagatggcagcgaggcagagatttgtaaaaggcacagtcttggaygtcaggcagataatggtcagaattctacctgcttctctgagcctctgtgtctgcactggcacattgaaagaaaaaaaaaatgcctttttaggtgatgcat

SEQ ID NO: 121374 - DNA, 201 bp, Bos taurus
gggacagatgtattaatcgaaagagttcttggggaaggtatggaaagaaaaaccatcaggccaaactagagaaaaggaaataactaaccagcagggagatyctgtgtggctctagcctgagctgggaaggtatgagctggtggggtcaagtctcttactcaagaaactgagtaagattcatacggatgcaggaatctgaag

SEQ ID NO: 121375 - DNA, 201 bp, Bos taurus
gatgttaatatttaagaagtaggacactagattctattatctcacaagctctgtcaccaggccctctctgtagtcctgttatctaattattgggcttaaaytgcattagtgtgctagcaatttgtctaccactggaaaagtaattgacatttgggttactgcttcatatttgggagacttgctagctagttccgaagagcc

SEQ ID NO: 121376 - DNA, 201 bp, Bos taurus
ggtcatttaagagtggttttatgttctttaaaattcaagcacaggcgaacaaaaggctgcgtggcggcccatatgtaattagccagatcatgtaagcatcygatcagggtcttgttaatgaaggtggcttgacctcagtgaccccttgaatcagtgagaaagtgagtgcgaaaaacagtactaaggggaggttttgagaag

SEQ ID NO: 121377 - DNA, 201 bp, Bos taurus
taagggaagaaaagtctttcctcctacctgtcttatggtctctgacaggggccccataaaacggattgatgaaagacagatgaacaagagagcagtgtacraatttatttaacgtaagttttgtgtggctccagagccttcttaaggaaatgaggacatgaagaagcttgagcattttatgttaggtttgataaagagtgg

SEQ ID NO: 121378 - DNA, 201 bp, Bos taurus
gatgctatatgcaactgttcttcaccagtcctattttaatttgcatgatatgaactctggtatttccaaaaaaagagatcagaatctggtttggaagactytcctccttaaaataaacaagcttcatgtccaagccaaggactggaaagtctctctgtggtccatcagggtaatgattcatggggcagcatctgtccctgg

SEQ ID NO: 121379 - DNA, 201 bp, Bos taurus
gttttgtaaacgtggccgaatcttaatgtgccctcttggatatatttgttggagacaagagacagtggaaatgacaatgctgggtttgacccaagccgagmatgttagagaggacagggccaaggatggtgatttttaaaggatggtgaccttgttgtatatgcaattgataaccaataggacctactgtatagcacaggg

SEQ ID NO: 121380 - DNA, 201 bp, Bos taurus; identical to SEQ ID NO: 40502

SEQ ID NO: 121381 - DNA, 201 bp, Bos taurus; identical to SEQ ID NO: 40506

SEQ ID NO: 121382 - DNA, 201 bp, Bos taurus; identical to SEQ ID NO: 40508

SEQ ID NO: 121383 - DNA, 201 bp, Bos taurus; identical to SEQ ID NO: 40509

SEQ ID NO: 121384 - DNA, 201 bp, Bos taurus; identical to SEQ ID NO: 80807

SEQ ID NO: 121385 - DNA, 201 bp, Bos taurus
gtgtgcgtgcgcatgtgtgtgtgtgtgtgtgtgtttctccatgaatatgaccaaagaaggcactccttggcgcaatgcttcactatcatcgtagcaagctrttttcttctatcacacagcaacctcttttcttctctctcccctatgattgtcagttgtaacattttctttttccctctctggtacattttttctggggag

SEQ ID NO: 121386 - DNA, 201 bp, Bos taurus; identical to SEQ ID NO: 40512

SEQ ID NO: 121387 - DNA, 201 bp, Bos taurus
ttattaagttcagaaacatgtctactttgggaacaccaaactcactgctcagaatgcatccctgtatcggcattacatgctttaatgtatattttttacckagatgactcatttctttccaaggaagagactatttctaaccaagctgtgaatctagtgacattcaagaaagtgagttgctcagtcgtgtctgactctttg

SEQ ID NO: 121388 - DNA, 201 bp, Bos taurus; identical to SEQ ID NO: 40513

SEQ ID NO: 121389 - DNA, 201 bp, Bos taurus
attctattaggcacacgtggaatatggaaatgacaggtccccataggaaaaaacaaacggtgctgttatgagaagaacaggaaaggggtgccagatagtcraaaggaagacgtgctcatctcagatacaggtttttattccttaagtaccctggactgtgtacatctttccaaaagattattctgtaagagatcaatacac

SEQ ID NO: 121390 - DNA, 201 bp, Bos taurus; identical to SEQ ID NO: 40515

SEQ ID NO: 121391 - DNA, 201 bp, Bos taurus; identical to SEQ ID NO: 40516

SEQ ID NO: 121392 - DNA, 201 bp, Bos taurus
acctacctaaaaggacggtagtgagaaggaagtggaatcagatctgtagaagtacttgaaacatctcaagtctgttcatttgcaacacaagctggcctccrtacagagaaggcaaggaaagatcaaagagagaggcagatcactccaattggtggttgttgttcagttgctaagttgtatctgactcttttcgaccccatg

SEQ ID NO: 121393 - DNA, 201 bp, Bos taurus; identical to SEQ ID NO: 40520

SEQ ID NO: 121394 - DNA, 201 bp, Bos taurus
cagtccatgaggcagagtgcagcaactctgagcaggctcccagctgaaaactaagacaattctgaatgaatgagaaatttctttgagtggcaattaaaaamataaaaaataaaaatttatttttaagacaattttcaaataagttgaagcaattattttcagagccaaccaatagcaccaactaggactgggaagggaaga

SEQ ID NO: 121395 - DNA, 201 bp, Bos taurus; identical to SEQ ID NO: 40523

SEQ ID NO: 121396 - DNA, 201 bp, Bos taurus; identical to SEQ ID NO: 40527

SEQ ID NO: 121397 - DNA, 201 bp, Bos taurus; identical to SEQ ID NO: 40528

SEQ ID NO: 121398 - DNA, 201 bp, Bos taurus
gtcacccgagcatctgcattaaaggactctctagcaggacctgctacataaagtgtgggtcccagcatacaatgaaaacacagggcccctcattcaaaaaytaagattcaagacagcgactcagagcacgcaggaaagtgtggggagtgggcgtctgagcacagggccctggctgtatgctttgcttactcgtgaagctgg

SEQ ID NO: 121399 - DNA, 201 bp, Bos taurus
agctacaaaacctgtacacatcactctcaggccatttacaggaaggcttgccgcccccgaggggcagataacctggtcactgtctccccaggcagccaggrgagggccagaacctgtcccactcaccactgcgtctgcagcatctaaaaccccacctgctcagagagagcgcttgtaaaatatctgcagaatgaagaacag

SEQ ID NO: 121400 - DNA, 201 bp, Bos taurus; identical to SEQ ID NO: 40530

SEQ ID NO: 121401 - DNA, 201 bp, Bos taurus; identical to SEQ ID NO: 40531

SEQ ID NO: 121402 - DNA, 201 bp, Bos taurus; identical to SEQ ID NO: 40532

SEQ ID NO: 121403 - DNA, 201 bp, Bos taurus; identical to SEQ ID NO: 40533

SEQ ID NO: 121404 - DNA, 201 bp, Bos taurus; identical to SEQ ID NO: 80830

SEQ ID NO: 121405 - DNA, 201 bp, Bos taurus; identical to SEQ ID NO: 40535

SEQ ID NO: 121406 - DNA, 201 bp, Bos taurus; identical to SEQ ID NO: 40538

SEQ ID NO: 121407 - DNA, 201 bp, Bos taurus; identical to SEQ ID NO: 40540

SEQ ID NO: 121408 - DNA, 201 bp, Bos taurus; identical to SEQ ID NO: 40541

SEQ ID NO: 121409 - DNA, 201 bp, Bos taurus; identical to SEQ ID NO: 40543

SEQ ID NO: 121410 - DNA, 201 bp, Bos taurus; identical to SEQ ID NO: 40545

SEQ ID NO: 121411 - DNA, 201 bp, Bos taurus; identical to SEQ ID NO: 40547

SEQ ID NO: 121412 - DNA, 201 bp, Bos taurus
gccaccaggaggagggcacttctcccacgcggtgccgaggaccatcctcgcagacccatcgaggaatcaccgtctcagtgacagtaaagaaccgacagccytcacaggctttcgaccataaacaacttgacccctgggtttatgaggtatggttagtatttcccaacatgcagaacagaggagaatcctagagaattcctg

SEQ ID NO: 121413 - DNA, 201 bp, Bos taurus; identical to SEQ ID NO: 40548

SEQ ID NO: 121414 - DNA, 201 bp, Bos taurus; identical to SEQ ID NO: 80839

SEQ ID NO: 121415 - DNA, 201 bp, Bos taurus
ttgataattcattgattcttccagggctggttcactcctgggtatggctctatcaatatggccctggtgtgtttttgttggaatcgggtcattctctgctrgtctttagcgggagagagtaggtgacgatttcttcaaagagaaggcttcttcaaagccaaaccccctctcatgctgagaaaatttgcaaaacagtcccat

SEQ ID NO: 121416 - DNA, 201 bp, Bos taurus
tgcatttttcatataacttggccaccaaacagaagccacttacttcatctggtgctcaaccagagaaacagccattgtgggtaattttggctgagcatgaytttagctgctccctctggccttagatttctgcacaagacaggattccaatgaatagctttgtgaaattcctacttggtgccatggataatcccacaatgg

SEQ ID NO: 121417 - DNA, 201 bp, Bos taurus; identical to SEQ ID NO: 40549

SEQ ID NO: 121418 - DNA, 201 bp, Bos taurus; identical to SEQ ID NO: 40550

SEQ ID NO: 121419 - DNA, 201 bp, Bos taurus; identical to SEQ ID NO: 80843

SEQ ID NO: 121420 - DNA, 201 bp, Bos taurus; identical to SEQ ID NO: 80844

SEQ ID NO: 121421 - DNA, 201 bp, Bos taurus; identical to SEQ ID NO: 80845

SEQ ID NO: 121422 - DNA, 201 bp, Bos taurus; identical to SEQ ID NO: 40553

SEQ ID NO: 121423 - DNA, 201 bp, Bos taurus; identical to SEQ ID NO: 40554

SEQ ID NO: 121424 - DNA, 201 bp, Bos taurus
catttgggcagagttccagatgaagatagggagtgaatcatgtaattattggtcagtgtccaaggcaaggggaaagagcaggtggaaaggccccaaggtcrggatatttgtatgatggaggatctgcagtgaagccaatatggctgggggactgttacagggggcaagtggtgagaaaaggggccaggagccaaatggtga

SEQ ID NO: 121425 - DNA, 201 bp, Bos taurus; identical to SEQ ID NO: 40557

SEQ ID NO: 121426 - DNA, 201 bp, Bos taurus; identical to SEQ ID NO: 40567

SEQ ID NO: 121427 - DNA, 201 bp, Bos taurus
tttattggaacacagccacacccatttgtttgtgtgtcatctgtggctgcttgtgtgctgcagaggccgagttgagtagttgagacttgtgtggcctgcaraggtgaaaatatttactctctggtcccttagagagcaagtttgccagtgtctgaatatcttacctatagcctggtcttaagctcagttggatttccttgt

SEQ ID NO: 121428 - DNA, 201 bp, Bos taurus
cataaagtttgggagtggagaatcagttgacccttaaagacacttgtatgtatttcagaagttttctcatgccaagctaagagcagtttcacgtagtatayttcagggtcaggaaggccgcccataaagggcattgtttgtgatcctttgaggacgttgaggtgctgttatggtgttttctttctccctctctgatttaca

SEQ ID NO: 121429 - DNA, 201 bp, Bos taurus
tgggaaactggcttttgacttctgcctgtcctgcttctgcagaaggtggtcaccctgcagctttaggcctaaatcaccccaatttgcaggcccaacagaargagaattcccaacccacagaccctgtgtccatctggggaaggtggactgatgggcaaactgcaggatctgatgggcaaacagcaggattgcaggggcctg

SEQ ID NO: 121430 - DNA, 201 bp, Bos taurus; identical to SEQ ID NO: 40572

SEQ ID NO: 121431 - DNA, 201 bp, Bos taurus
ttggttatatgatgaagtaaactcttaattttaaagacataataaatgttttattacttgtaaccaaaatagtcccaggtgataaatagatggccaaagayttgtgtgaccataggagcttgcctcagttctatctcactcctggttagatgggctgagcccaaggcgggcagcctctatgcttggctacatgcccagcca

SEQ ID NO: 121432 - DNA, 201 bp, Bos taurus
ggctccccacatccacagaagggggacactgcagtgcaggccccaggacactttgggacttgttcagcccactttgtttgtagaagagaagcatctcctcrttgtcaggagctgagggcctgggctcggatactggagccacccctaactattggtctgagttcagaccagtcacgttactcttctctgcctcagtgttcc

SEQ ID NO: 121433 - DNA, 201 bp, Bos taurus; identical to SEQ ID NO: 40573

SEQ ID NO: 121434 - DNA, 201 bp, Bos taurus; identical to SEQ ID NO: 40574

SEQ ID NO: 121435 - DNA, 201 bp, Bos taurus; identical to SEQ ID NO: 40576

SEQ ID NO: 121436 - DNA, 201 bp, Bos taurus; identical to SEQ ID NO: 40583

SEQ ID NO: 121437 - DNA, 201 bp, Bos taurus; identical to SEQ ID NO: 40584

SEQ ID NO: 121438 - DNA, 201 bp, Bos taurus
gctgaactaacttcacagccaccaggaaagggagagggcagaagtgtctccacagcatcaccagcaccgagtattaacatgtgacggtagggtgtgggatyagtgtggccgccaaaacaatttttgcttgcgtttctttgattgactatctggccacatactgaattacatctcctcctctgtgtggaaacactgactttc

SEQ ID NO: 121439 - DNA, 201 bp, Bos taurus
gatttcctcaacttcagtcactatcagaataaaattcaaagttctcagcctggcctacaacaggtttttctcaccatgagcactgttgacgctttcggccraatattctatgtgtgtggtggtggaagagctgtctggtgagtgctaggatatttatgggcattcctgggcctcatccagaaatgccaacatcacccccat

SEQ ID NO: 121440 - DNA, 201 bp, Bos taurus; identical to SEQ ID NO: 40587

SEQ ID NO: 121441 - DNA, 201 bp, Bos taurus; identical to SEQ ID NO: 40588

SEQ ID NO: 121442 - DNA, 201 bp, Bos taurus; identical to SEQ ID NO: 40589

SEQ ID NO: 121443 - DNA, 201 bp, Bos taurus; identical to SEQ ID NO: 40590

SEQ ID NO: 121444 - DNA, 201 bp, Bos taurus; identical to SEQ ID NO: 40591

SEQ ID NO: 121445 - DNA, 201 bp, Bos taurus; identical to SEQ ID NO: 40592

SEQ ID NO: 121446 - DNA, 201 bp, Bos taurus; identical to SEQ ID NO: 40593

SEQ ID NO: 121447 - DNA, 201 bp, Bos taurus; identical to SEQ ID NO: 40594

SEQ ID NO: 121448 - DNA, 201 bp, Bos taurus; identical to SEQ ID NO: 40595

SEQ ID NO: 121449 - DNA, 201 bp, Bos taurus; identical to SEQ ID NO: 40596

SEQ ID NO: 121450 - DNA, 201 bp, Bos taurus; identical to SEQ ID NO: 40597

SEQ ID NO: 121451 - DNA, 201 bp, Bos taurus; identical to SEQ ID NO: 40598

SEQ ID NO: 121452 - DNA, 201 bp, Bos taurus; identical to SEQ ID NO: 40599

SEQ ID NO: 121453 - DNA, 201 bp, Bos taurus; identical to SEQ ID NO: 40600

SEQ ID NO: 121454 - DNA, 201 bp, Bos taurus; identical to SEQ ID NO: 40601

SEQ ID NO: 121455 - DNA, 201 bp, Bos taurus; identical to SEQ ID NO: 40602

SEQ ID NO: 121456 - DNA, 201 bp, Bos taurus; identical to SEQ ID NO: 40603

SEQ ID NO: 121457 - DNA, 201 bp, Bos taurus; identical to SEQ ID NO: 40604

SEQ ID NO: 121458 - DNA, 201 bp, Bos taurus; identical to SEQ ID NO: 40605

SEQ ID NO: 121459 - DNA, 201 bp, Bos taurus; identical to SEQ ID NO: 40606

SEQ ID NO: 121460 - DNA, 201 bp, Bos taurus; identical to SEQ ID NO: 40607

SEQ ID NO: 121461 - DNA, 201 bp, Bos taurus; identical to SEQ ID NO: 40608

SEQ ID NO: 121462 - DNA, 201 bp, Bos taurus; identical to SEQ ID NO: 40609

SEQ ID NO: 121463 - DNA, 201 bp, Bos taurus; identical to SEQ ID NO: 40610

SEQ ID NO: 121464 - DNA, 201 bp, Bos taurus; identical to SEQ ID NO: 40612

SEQ ID NO: 121465 - DNA, 201 bp, Bos taurus; identical to SEQ ID NO: 40614

SEQ ID NO: 121466 - DNA, 201 bp, Bos taurus; identical to SEQ ID NO: 40615

SEQ ID NO: 121467 - DNA, 201 bp, Bos taurus; identical to SEQ ID NO: 40616

SEQ ID NO: 121468 - DNA, 201 bp, Bos taurus; identical to SEQ ID NO: 40617

SEQ ID NO: 121469 - DNA, 201 bp, Bos taurus; identical to SEQ ID NO: 40618

SEQ ID NO: 121470 - DNA, 201 bp, Bos taurus; identical to SEQ ID NO: 40619

SEQ ID NO: 121471 - DNA, 201 bp, Bos taurus; identical to SEQ ID NO: 40620

SEQ ID NO: 121472 - DNA, 201 bp, Bos taurus; identical to SEQ ID NO: 40621

SEQ ID NO: 121473 - DNA, 201 bp, Bos taurus; identical to SEQ ID NO: 40622

SEQ ID NO: 121474 - DNA, 201 bp, Bos taurus; identical to SEQ ID NO: 40623

SEQ ID NO: 121475 - DNA, 201 bp, Bos taurus; identical to SEQ ID NO: 40624

SEQ ID NO: 121476 - DNA, 201 bp, Bos taurus; identical to SEQ ID NO: 40626

SEQ ID NO: 121477 - DNA, 201 bp, Bos taurus; identical to SEQ ID NO: 40627

SEQ ID NO: 121478 - DNA, 201 bp, Bos taurus; identical to SEQ ID NO: 40628

SEQ ID NO: 121479 - DNA, 201 bp, Bos taurus; identical to SEQ ID NO: 40629

SEQ ID NO: 121480 - DNA, 201 bp, Bos taurus; identical to SEQ ID NO: 40630

SEQ ID NO: 121481 - DNA, 201 bp, Bos taurus; identical to SEQ ID NO: 40631

SEQ ID NO: 121482 - DNA, 201 bp, Bos taurus; identical to SEQ ID NO: 40632

SEQ ID NO: 121483 - DNA, 201 bp, Bos taurus; identical to SEQ ID NO: 80907

SEQ ID NO: 121484 - DNA, 201 bp, Bos taurus; identical to SEQ ID NO: 40636

SEQ ID NO: 121485 - DNA, 201 bp, Bos taurus; identical to SEQ ID NO: 40637

SEQ ID NO: 121486 - DNA, 201 bp, Bos taurus
cttgcctgaagccataaatccttaagattctctgtgatgtgattcagtaaatgtgaccatttcagctagatttctataatcaaaatatgtctaatataaaycaaagaggatgatatgtgatagtttgtccttattcttactctccctactactaatgttaagttgccaaggacataaaatatgcccttccatctttgtagc

SEQ ID NO: 121487 - DNA, 201 bp, Bos taurus
atctgatggcttagggctcctgaggaggccctaagtggaatctggtgcatcgtcctgacccagagtgacatagcatcaggccctctgcaatcaaagagttwaagtatttgacaagacctgtgcagattcagagtgggaaggagctgcccaagactgtggcttgtgggtcatgggagatgggctccactgggggccatcttt

SEQ ID NO: 121488 - DNA, 201 bp, Bos taurus; identical to SEQ ID NO: 40638

SEQ ID NO: 121489 - DNA, 201 bp, Bos taurus
caggcccgagagtccgggagtcacaactactgaagcctgcacgcctagagcccgcgctctgcaacaagaaaagccactgcaatgagaagcctgcgcgcccyaacgagagagtggccctcgctcagcacagcgagagaaaaacctgaaaagcagcgaagacccagcacagccagaaataaataaataaataaaattatagca

SEQ ID NO: 121490 - DNA, 201 bp, Bos taurus; identical to SEQ ID NO: 80911

SEQ ID NO: 121491 - DNA, 201 bp, Bos taurus
ggtactagggattcgggaaccaccagacagatcaaatcctgccttaaagcaagagagtgcctagcacattggtgacaatatggaaactcctgggagcagargggcctggctcttgtgtggatcagtcatggacagtgcagattagtgcaccccgccaaagagctgtgactggagtccctcagagtccccttccctctggtg

SEQ ID NO: 121492 - DNA, 201 bp, Bos taurus
acgtccattgagtcattctgatgcatgggccatattttgaatagtgtcttttaaaaatacaaataccatgaagtctcctctttgttgcaaccttctggagrtttctcattgtacttggaacaggccccaacttcctgcctgtcttttgaaccaccacccacctccaccaagattgtcaagcctccgcctatcctttgacac

SEQ ID NO: 121493 - DNA, 201 bp, Bos taurus
ttttttgctgcacctggaggcatttggcatcttagttccctaaccagggatcgaacctgggtcccctgcagtgaaagtttgtagtcttatccactgggccrctagggaattccctgtggatgcccctaaggaggactttactaagggcaaggactctctcccacctcccttcatgtatcaggttagtagggttcaagctga

SEQ ID NO: 121494 - DNA, 201 bp, Bos taurus; identical to SEQ ID NO: 40646

SEQ ID NO: 121495 - DNA, 201 bp, Bos taurus; identical to SEQ ID NO: 40648

SEQ ID NO: 121496 - DNA, 201 bp, Bos taurus; identical to SEQ ID NO: 80918

SEQ ID NO: 121497 - DNA, 201 bp, Bos taurus; identical to SEQ ID NO: 40649

SEQ ID NO: 121498 - DNA, 201 bp, Bos taurus; identical to SEQ ID NO: 80921

SEQ ID NO: 121499 - DNA, 201 bp, Bos taurus; identical to SEQ ID NO: 80922

SEQ ID NO: 121500 - DNA, 201 bp, Bos taurus; identical to SEQ ID NO: 80923

SEQ ID NO: 121501 - DNA, 201 bp, Bos taurus
ggaccctcctggagaagagctagggcagagtctgctcccctagatgggactctgagggccatggcatcaggctggtgggtctactagtggcctctggctgyggcaccttccactgtggggacagtagtaagactccttgcctgtgtgagtcagcaaaaagcatgagaggtatagcaccagctgcaggtgaagggtccctct

SEQ ID NO: 121502 - DNA, 201 bp, Bos taurus; identical to SEQ ID NO: 80925

SEQ ID NO: 121503 - DNA, 201 bp, Bos taurus; identical to SEQ ID NO: 80926

SEQ ID NO: 121504 - DNA, 201 bp, Bos taurus; identical to SEQ ID NO: 80927

SEQ ID NO: 121505 - DNA, 201 bp, Bos taurus
acctgagacttcatctctctttggggtgtggctacccaaatggcttggccttttcttctcacacagctctggttactggagttgccggccaggtctgggaygggagccctagggaattcaatcccatcccaacaaaaggatcacagattccggcagcttggggcagggcagaggattctgggagggggctgggcaggctgg

SEQ ID NO: 121506 - DNA, 201 bp, Bos taurus
ccagtccgaggtcaaaggcccaaggaccagaagctgtagtatcagagcagaaggtgggcatccagctcacgaagacagtgaatttgccctcctttcacctktttgttccatttgggcccccaatggatggggtgatatccacccacactggggagagcagtgcactttaccgtctatgggatctcctgctaatcccttcca

SEQ ID NO: 121507 - DNA, 201 bp, Bos taurus; identical to SEQ ID NO: 80928

SEQ ID NO: 121508 - DNA, 201 bp, Bos taurus; identical to SEQ ID NO: 80931

SEQ ID NO: 121509 - DNA, 201 bp, Bos taurus; identical to SEQ ID NO: 80932

SEQ ID NO: 121510 - DNA, 201 bp, Bos taurus; identical to SEQ ID NO: 80933

SEQ ID NO: 121511 - DNA, 201 bp, Bos taurus; identical to SEQ ID NO: 80934

SEQ ID NO: 121512 - DNA, 201 bp, Bos taurus; identical to SEQ ID NO: 80935

SEQ ID NO: 121513 - DNA, 201 bp, Bos taurus; identical to SEQ ID NO: 80936

SEQ ID NO: 121514 - DNA, 201 bp, Bos taurus; identical to SEQ ID NO: 80937

SEQ ID NO: 121515 - DNA, 201 bp, Bos taurus; identical to SEQ ID NO: 80939

SEQ ID NO: 121516 - DNA, 201 bp, Bos taurus
ctggctgtggggtgagggtgtgaagaagaggccaagagactgggtcttcgtgtcatggaccacacagatgttgtgtgatgttgacatggatcagcaggacmttggcctgagtgggccaggcagctcagaaagaacaagaatgaccaagggctggaaccatccatgagactgtgtttgtgctcactcagtcatgtccaactc

SEQ ID NO: 121517 - DNA, 201 bp, Bos taurus; identical to SEQ ID NO: 80940

SEQ ID NO: 121518 - DNA, 201 bp, Bos taurus
agggcccgtgctctccaacaggagaagacactgcaaaaaagaagcccacgctccacaactagacaatagcccctgctcaccaaatatgcatgcaacgacaragacccagagaggccaaaaatacacacacagagaaggctgcgtgaggacacagggagaggacagccatctgcgagcctaggagtgaggtctcaaaggaat

SEQ ID NO: 121519 - DNA, 201 bp, Bos taurus; identical to SEQ ID NO: 80941

SEQ ID NO: 121520 - DNA, 201 bp, Bos taurus; identical to SEQ ID NO: 80943

SEQ ID NO: 121521 - DNA, 201 bp, Bos taurus
gagtcccacactgtcatttactccagggcaagtgcagcgtgaatggccaccttaaatacaggtttttatgaatctatttattacatggtcggccacataayagtttgatgctgaactgtgtgttagctttacaggtacaagtgcgagtgactgaagggcctcggtgggtctggaatcaagaagagaccacaaaccatcccg

SEQ ID NO: 121522 - DNA, 201 bp, Bos taurus
atggggcaaacaggcctttttggaattagtttctcctcttggttaatgagggtcaggggagaatgaaggaacaaaccgagatgcttggtacaacccaggakgctgaccccttgagggagatgctgatggagtggggccagggccacctctgtggtccctcgggacctctgaaatcacagaaggttagagaggaagtcagga

SEQ ID NO: 121523 - DNA, 201 bp, Bos taurus; identical to SEQ ID NO: 80951

SEQ ID NO: 121524 - DNA, 201 bp, Bos taurus; identical to SEQ ID NO: 80952

SEQ ID NO: 121525 - DNA, 201 bp, Bos taurus
ttataattttaattgtggctaaaaaaaaaatttaatctgaagctcatgtccctaactaaagctaggattttaaaagtctgccccatgtgggtttctgagaygccacaggaagggctaaataaatggaacacacggttaatgccttctccaaccccactttacccacaacagctgggtttctgcttttatatttggttatgc

SEQ ID NO: 121526 - DNA, 201 bp, Bos taurus
agaagaaaactatctttcagtccctgagtgcataccaaataggtagcctgggaatataacctggagacccactggggaaaggtctctgggatggaaaacakttacaagacaagtaattgagaactgattatgctacaaataaattccctaaggcctgaaatccatcttcttctggaggaacctgaaaaaccatgagcactg

SEQ ID NO: 121527 - DNA, 201 bp, Bos taurus
aaatagtaaacagagggcacccactgccctattggtcctaatagaaaacatcagaacagggctattacaaaccacctgacaggcaaggaacaacacaaggmaaagtctaaaacacacagatcctacctagtattcaaaatctgggacaggcccgagagtaaaaagagtaatacagaactcatatggtataaatatataaaa

SEQ ID NO: 121528 - DNA, 201 bp, Bos taurus
atttgatagatgtagcatacggttggggttacttcagatccttctaacaatacaggtagattgactctcattgaatagagaatcgtttatggaaacattgyggcacataagccaagttatttaagacagcataataaatttgatgtttcctttcacctgactgcatttctgaagaatattcactgttcgacacccacacat

SEQ ID NO: 121529 - DNA, 201 bp, Bos taurus
aagcacaattggcattggaagtgaggacagccttatagaggactaagccttaactagtgggtctgtactcactgcaggtggtaacactagaatcgaattgygggaaccagttaagagttggaacagaatatctgcaccaccagtgagtgaatacacgagtatcaagggttgaattccagacctgatgtcacagaaaaatga

SEQ ID NO: 121530 - DNA, 201 bp, Bos taurus; identical to SEQ ID NO: 80960

SEQ ID NO: 121531 - DNA, 201 bp, Bos taurus; identical to SEQ ID NO: 80961

SEQ ID NO: 121532 - DNA, 201 bp, Bos taurus; identical to SEQ ID NO: 80962

SEQ ID NO: 121533 - DNA, 201 bp, Bos taurus; identical to SEQ ID NO: 80964

SEQ ID NO: 121534 - DNA, 201 bp, Bos taurus; identical to SEQ ID NO: 80965

SEQ ID NO: 121535 - DNA, 201 bp, Bos taurus
gaaaaaaaggaaacattaaaaaaaaaaggtgtgtgacaagcccaaagtcatacagggagaatcatttcccagaggctgtgcactgaactggaccataatcygctttcctgtcccatttcattccctgtcacagtggcaaggttccatggcaaccacaaaagctggtaaatctaatcaggaccagcaaggcgagtgttctgg

SEQ ID NO: 121536 - DNA, 201 bp, Bos taurus
ctgaggacaaatggaaattgtgtgtgagaaacaattgtgagagtgagaaatatagaggcctagtgcctgctcaggaccaatggcaagcaagggcctgaagraccatcactgagccaaaaaaggtcagaagacaaatacaagctgcgatgggagagggatgcaaaggacggtgggggaatgttgccatctgagggctgatgt

SEQ ID NO: 121537 - DNA, 201 bp, Bos taurus
tcacagcatccagcatattgtctaatcaaggcttaattcttgagctatgtggacacatacatgacaatagcagttactaccatatcagggacaggagagaracttttcatataatagagcaggatgggatgtacagatgaatatttaggtccttcagtgtagtgtcagttttatcttttgtatgtcacaggctgtccattg

SEQ ID NO: 121538 - DNA, 201 bp, Bos taurus; identical to SEQ ID NO: 80966

SEQ ID NO: 121539 - DNA, 201 bp, Bos taurus
ctcgccagccacccctggagcacatggctttgaaactggtggagctatcaagcaggcgctcaactcactgtcccgaaccctgtggtttggactcctgcttyggccatgacgttagtgagaatgtagcctgtctgtcctacaactggtagagtccctaagtcttcgggtcccctgaattgtcacttcactctttagtaggga

SEQ ID NO: 121540 - DNA, 201 bp, Bos taurus; identical to SEQ ID NO: 80968

SEQ ID NO: 121541 - DNA, 201 bp, Bos taurus
gagatggtaatgtggctcttacagctctgagaggggattttcttttccttcctgtaggattaagtggattcagcatgacatggccaatctgacagagtgaktaaaaaaaaaaaaaatcagctaacataggtgggtccagaaagaggcatcaggtccagtcaggagcatttgaggtcagcaaggaagtggaagacatgcaaa

SEQ ID NO: 121542 - DNA, 201 bp, Bos taurus
gtggttcagagctccgccaatcgcagatatgaaagttgagctcagatggcatactgatagcatatcaatagcataatattctacggcctcctattggccayaggcaagtgtcatttcacccgagaggaaatgaacaagagcctgactcacagaaggtgtgttcactggggccatcttcggagacgggctgccagagtttct

SEQ ID NO: 121543 - DNA, 201 bp, Bos taurus
agtgactaaacaacaacacatttccaaagaacttgttctatcctccttactgtttccttctgggctgtgttttagacaaagtgtttcctgcaattaggtcrctggatctgtgccttatttcctttacctttaatcttttataaactatgacatttacaaacctccccatgaccaatctgtgaaacccaccatctctcgctg

SEQ ID NO: 121544 - DNA, 201 bp, Bos taurus; identical to SEQ ID NO: 80972

SEQ ID NO: 121545 - DNA, 201 bp, Bos taurus
caaagagctgcagtaaggccagccttaagcacagctgaaacaaccacatcagcaagtcacatccctcaggctctccattggtcaggcctgtacttggcacytacacataccatcccacctccttaaaacaacccaggttacagttgaggaaaatgaggcaccagggtgtgaatggtaggggtttggaggcccctcagcctc

SEQ ID NO: 121546 - DNA, 201 bp, Bos taurus
cgtctgtgtgtggaccaggctgtcctctgggctgggctggccgtcctccggggtcgcggcctcaggcagcagagctgagtctctctcctctgagcctcacrtcctccaggttcattcacctggcagctctgctccaaaaacaacagaagcggagccccaggcacatttcaagcctctgtctacatcccattggccgaagca

SEQ ID NO: 121547 - DNA, 201 bp, Bos taurus
agaccactgggcttccccctgggatgctcaggacagacctacagaagaacttcccaagacagttcccaaaagggacgtgagaaatgggggccactgcagaragaaggtagaggctggactgggaggaaggggctttgaagaaagaaggagctgctcagagcctgagggggttgcccagcttcctgcagacccaaaggagaa

SEQ ID NO: 121548 - DNA, 201 bp, Bos taurus
cagtctttcattgctttcagtgaagcacacagcaggcctaaacaaacacttgcttctaaggaatctttaaaactacaacatatgcattttcagccaacagyctggcttacagcaaccattagaaatgaagggcacaaggcaccaagttaaaagacaaccttctcgtcacacaaccacactcaacaccactggtctcagtgc

SEQ ID NO: 121549 - DNA, 201 bp, Bos taurus
aaggagataatttttttaattcttatgtagtagaaagaagggggaaaatgccctaatggaaaaataggagattccactagtattctgctatatatataatrtaaattatatatatatataatatatatatataaaatattatatatatataatacttaaagacagtaaatacactacctcctcctgcttagaatatataat

SEQ ID NO: 121550 - DNA, 201 bp, Bos taurus
ccaccagggaagtccctctgatgacctttgcttctccccactctgcctcgcaaatcccagggaatccaggccagagacgtgatggctgtggggaccttaargaaggtcggagcagagacctgactcccagcccagagggcagggatggctgcagaaagcacccagaatgctgcaccctttcacggtcagaccagaccgaga

SEQ ID NO: 121551 - DNA, 201 bp, Bos taurus
ttcctcaccctggtgggctcaggccctctgctgttaatctgagaccacccatggccccatgtaggactcagatcttgtcggggggatctctatgctccccrctttcctccccagacagttctgggctcccaactgttcctggacagctagccacagacatctcaggacaaggaaagagccagtaaaccctcttactccact

SEQ ID NO: 121552 - DNA, 201 bp, Bos taurus
caagcttcgctgctgctttagccgctgctgctgcagcctgggggccaacccctgggggaagaggaaggggagagcctggaaagtgtgccccgggatctccrgagcccgtctcttccaggcccaagaaaaccaactggttcatatctgggtgtggatgtggggcatatagcaagcagaggctgggagagctgccccagcttc

SEQ ID NO: 121553 - DNA, 201 bp, Bos taurus
ctgatgccttagctaagacacagagcagccaaataaataaaattttaaaaggccatgtgatgatgtgggggtgcagacacacagggagaagatggccatgygaagatggaggtagacaagccaaggaacaccaaggatggctgtcaaccatcagaaactagaaagaggcatggaagcgttcttccttagagcctttgaaag

SEQ ID NO: 121554 - DNA, 201 bp, Bos taurus
ggagacccttggggcggcagtcagactcaccaggccaggcggaacggggagggggcagaaagcagaaaagtcattcatccaatttgtcacccacctctcaraaggacactggcctaagggaagggaagtgtacgctgcagtggatggagcagccagctgcaggccaagtgaccggagatggccggggcgggggacgcgccc

SEQ ID NO: 121555 - DNA, 201 bp, Bos taurus
ctcagaagatcagagttagtcttagcattccgggagaatccagaaccttgaccacagcctttcctacaatgctttcctgtctgggtcccagcaggtgcccygagatgctccaaggatgaggctctcaagccatttataaatttttttaaaagcgcgccctctggtggcccgtgagtgcagggcacagttgcagtctcactc

SEQ ID NO: 121556 - DNA, 201 bp, Bos taurus
caaaaggccgacctggctgaagttgaaaatttgtatggaagtcagtaagagaaaagattgaatagggacatggagtgacaattccagccaaatttctctgrctggtattgtatcccaggcccttcactgcctccttcccagacccaacaatggagcccctggagttgttccagcccccacattttttccttttattgaagt

SEQ ID NO: 121557 - DNA, 201 bp, Bos taurus
tctcctgcctccatcacccccttgctgtggctgccagccccactctcccattagacctgtattattcctggctgagtgcccagcaccccccccccagcacyccccacctcagggtaaacccctggaggtttcaaaggaagaagatggtccctcatgtcgaatatggtgtctataaacacttcccctgccaggcttgcggtt

SEQ ID NO: 121558 - DNA, 201 bp, Bos taurus
agacctcagtgcagagtaaagtctgcccaaccagaaccccgaaccctggggccctgtctcctttgaacccatttctgggaggatagtccgtgctggctacycctgaccacggtgatttccggccagctctgggcagggacccctggagaagcaccccaccccctgcccactgtccttgcctccaaacagcccattttcttt

SEQ ID NO: 121559 - DNA, 201 bp, Bos taurus
aagaaggtctgggttgtatactggagttaacttttagccttaaacttaagttttaagttttagcctaaaacttaagttttagctgctgcagtatgggaccrtgagacataatacacaaaactggtaggatttttcatcacacaggaacaagtgtattgttattaaaatgagaagttatgctctaaaacttaccaagaaacc

SEQ ID NO: 121560 - DNA, 201 bp, Bos taurus
cacccattcattcactcgctcacccaatgatttgtacatttccctataggcaaatcctatggtttgcacaagctctaagtcatggggccaacaagacataygaaccatgagactcagaagggcatccctagagagggtccttagggacacaaagcaactggttcgggggccctgcagggtgatgggctcttccgtgggggc

SEQ ID NO: 121561 - DNA, 201 bp, Bos taurus
caggtggaagacactcaggttgtgtctagagaggagtgagattgggagaggatttctgtggggctttcaggttcagtcaagattcaaaaggcaagaggatmtgagctcaggccaggctgagtaggacagttagaggaagggtttcaaaggtgtccctttgacaattttctgtcttgatgggcaggtcctttggtttaccct

SEQ ID NO: 121562 - DNA, 201 bp, Bos taurus
ctgaatgcttatacatttggtggcccccccccgcttttttttttaatagatgcaaagctaccaaatgaggttcagggcttggaagggaccctgaaagtgaygggcctcgtggtgaattccctccgactcggctctgttgtcttctatgtagaccatgggtcaagcattttcttcttttttttctggctgcaccacatgact

SEQ ID NO: 121563 - DNA, 201 bp, Bos taurus
gaactgaatgttaatacaaaccaagcaggctcctcctcagaggctctttttcaatggccggcactgggttctggttgccatggtgacagctggagcagaarccaggagataatgtaaacacctggctttttgcagtattgaggagagcaggcaaaggtcttgtcccagctgcatgtggaaaaaaacgtggagggaggcagg

SEQ ID NO: 121564 - DNA, 201 bp, Bos taurus
acgtccggaaagaaacagggctttggggtggtaggaataccttcgcctcttcgtttgggaccactgcagtaaaagaggccaggggccgcagtctgcagttkttacgtgtgaatccttttaatgctgagtccgtcttcagagtcctctctctctgcctctttctagaacaatgctaaagtagccgtgctgggggcctctgga

SEQ ID NO: 121565 - DNA, 201 bp, Bos taurus
tgccaccgtcctctgagcacacgtgtcttctcagtgaaatgtgaggtgtgtggagatcagggctgaagaaaggtgtgaaacagcacctgtaagggggatgmtgggaataagcgtggggcccgtctgggctgctctgaccttatgtagaacgaccagcgtggttctgcaggaacttcaggacactggtgtgggtgccctggt

SEQ ID NO: 121566 - DNA, 201 bp, Bos taurus
ggggacacagatgaggccaacacaggtgggaaatctagagagtggcgaagtgaaaactcacacgcaccgagcgaggaaccctgaacagaagaacaatgcgygacaagaggacagcaagggggccttggtttggaccgactgtcagaggagaccactgtgagggctggcacctgaagtgagccttacaggatggatagcaga

SEQ ID NO: 121567 - DNA, 201 bp, Bos taurus
ggcctaaatcgctgtcacgtgtgcccccatgggacacctacttacttcatttaccaacatggacggtccctttactgggcactggacctgggcaggacgcygcctggccttcggggaccccggcagctaggagtagcctctgaggcgcggtgatagccgaggcccagctcacgggctggtcacctcccttcttcagacctg

SEQ ID NO: 121568 - DNA, 201 bp, Bos taurus
tcccaacgcccatcagtttatgaaagaataaacaagaggttgtatatatccgcacacaggatgctgttactcagccataaaaaggactgaagcgctgataygcacctcaacatggatgaaccagcaaaactcacagtgagagaaaaggggccagacgtgaaagcccacacacatgctgtatgatgccgtttatacgtgaag

SEQ ID NO: 121569 - DNA, 201 bp, Bos taurus
cctgacacctccatctcctaccccttcttcctctaacttgacattacactgtgtaagtttcagctccaggatatacctcattcactggtcaccatctccayggccaccaccccagtctcctctgccatcctccattgcctgcatgttggagcagtcacagttcctctacctgccatccatcctttacacagcagcccgagt

SEQ ID NO: 121570 - DNA, 201 bp, Bos taurus
ccgtcccctacccacccccggccaccccctcctccacctggaggcccggtgggtgcccgtgagccccttggtgaccctgcactcatatcgttttgttttcrttttagatgtgggccattttttaaagtcttcatcgaatctgttacaacatttcttcgcttttcatgtcttggcattttggccacgaggcatgtgggatct

SEQ ID NO: 121571 - DNA, 201 bp, Bos taurus
acaatgaataggactcagttcatactacctagggcccaggttcaattcctggttggggaactaaaatcccacaaagccaagtatggccaaataacaacackaagaaaggggacttccagtaacctggaaaaaatgctggctcactgcctctggtcaggcttgaacaagattctggtcaaggtgaacactggcccccgacca

SEQ ID NO: 121572 - DNA, 201 bp, Bos taurus
agtcgccaagcagcgagcccttcggatcgaggatcaccaccttgttgacctcgcgaagggtcagaaagatgtagcctttcttatccacggacacagaaccyggctggcagccatgcaggccaggtccccggtactccccaaccacctgacccagcccatcacagaccaccaagctattctgctgccaatcggaccctacaa

SEQ ID NO: 121573 - DNA, 201 bp, Bos taurus
atcctgacctgtaaagagaggtactggggtgagagtgagcctgggggaagcagaagagacacacaggatggattgtttgcagtaaaaaggatgggcttggrgagttggccccacagctgcgctaaactcctttcccactgcccatccatcctccccccagcccagcttatcagggatgcggaagaggggctggggaggtgg

SEQ ID NO: 121574 - DNA, 201 bp, Bos taurus
tccccgaacacacacccggaccgcccctcggagacaggacgcccaatccccgcctccaggtgccccactccgagttcaggccctataaatgctacctcacyggagatccaccctccctactcccgcggagagctccgcaggattaagtcttgtgaatcccgacccccaccctcccccaggccccaggggcagatgagccct

SEQ ID NO: 121575 - DNA, 201 bp, Bos taurus
cgtgccccagcccattatgtacccagaggtgaccatcagggcacccagggtgcttcctgccattggcacttgctgcaagagtttaggggtgcttctcaggrtcccatcaggagggcttcaaggaggaggcagcatttcaacaggatctcaaaggaggagaaggtggctaactcaggtggtgcctgggaggccgagcagggg

SEQ ID NO: 121576 - DNA, 201 bp, Bos taurus
aaagcattggagcgtcagcttcaatccttccaatgaatattcagtatgtatattctttttcatattcgtttccattgtggtttatcacaggatattgaatrtaagtctctgctatacaacaggccctgttgtttatccagtcttcatataatagtttgcatgtgttaatccaagagggcttcccaggtggccctagtggta

SEQ ID NO: 121577 - DNA, 201 bp, Bos taurus
gccaaactccatcatcacagtctgaaagcttgcctgggagagagaagcttgggggctgataaggcggtgtgataagcagctgtgatggaagcgcgggagcrgagcaggaggcagggaaacagctcacctctctgcgtttctccagcaggctctcgaggcgctcaggcgctctctgtcccgggcccttgttccgttcagcct

SEQ ID NO: 121578 - DNA, 201 bp, Bos taurus
gtttaaggacaaaggctgagaaaatgcaatgggaagagagaggccagggagttgactaacaggagaggaaacctctccttcaggtcattacacacaggtamtgtttctgcttgtccctctgacagggcctagaggttcccctgattgctgtggttcagtggtctacgccgaagttgcccttcacccagagcatctataccc

SEQ ID NO: 121579 - DNA, 201 bp, Bos taurus
tagcttcctgtgttctcactgattgtttcgctcctgaacaatggcttacagtcctgtcccctccgcaaccctgccaccctggaatcccagccccgaggccytctggattctaccaccaaaacatgtggcactcactgtcctgctccagccgctccttctccaccgccgacagcatcctgcgctgcctggctggccgcgtcg

SEQ ID NO: 121580 - DNA, 201 bp, Bos taurus; identical to SEQ ID NO: 80975

SEQ ID NO: 121581 - DNA, 201 bp, Bos taurus
gagcctctggcttaccaaggcttacatctttttactctattttctttattttcttttagataaaagctatatggaagtttaaatgttttcttttccacctkgatggactgccttgggaatcctctctgtgattcaaggcatttcagagtccacagactcaagaaaaattaatagtaggtcttttgagaacttgctgggagt

SEQ ID NO: 121582 - DNA, 201 bp, Bos taurus
caataatgccttacaacaatatacaagctactttagcatcgtgtatttttgatttttttttaaactaccaattcaatgtgttcaacagctatagggagggrcaggctgccaatatttccttgattcaattttaatagattatgactttcagaaaattggtctatttaacgtgttataagatatatgggcacaaaatcattt

SEQ ID NO: 121583 - DNA, 201 bp, Bos taurus; identical to SEQ ID NO: 80977

SEQ ID NO: 121584 - DNA, 201 bp, Bos taurus
cgagttttgcccaataaaagaagaaaagaatttgttttttggtttgttttttagaatttccatctccttcctctggtgtccaagtaaaactcttgggattrcatcaaggcttgaatgacctataggctgatacccagcagcggaaatggtcaaggccgtctggggtctaggtgctcccttcaggcccctgccccacgtggg

SEQ ID NO: 121585 - DNA, 201 bp, Bos taurus
attttggggatcatgctaatggtaaaaggcccatctttcagagatatgtgccgaaatatctaaggatgagatggtaaaatgtggggattgttttctgaatmatccagtggaggggggagagctggccgcgtggccagggatggtgtcggaggtgggtgaagagtccagcgcgttcaccgagctggcccctccctttgtgtt

SEQ ID NO: 121586 - DNA, 201 bp, Bos taurus
cacagtgtgaaccgctgactggtctccctggatcatctcccgggcctctcccgggggaaggagttggtgaccccaggccggccaggcgcactcaccgagcratcttgatgtagtaatgtgtcggctttggcatcagaaactccccgggaatttccacctcggccgtctgtgccgagaagttgctcagaaaccggcacttct

SEQ ID NO: 121587 - DNA, 201 bp, Bos taurus; identical to SEQ ID NO: 80980

SEQ ID NO: 121588 - DNA, 201 bp, Bos taurus; identical to SEQ ID NO: 40650

SEQ ID NO: 121589 - DNA, 201 bp, Bos taurus; identical to SEQ ID NO: 80985

SEQ ID NO: 121590 - DNA, 201 bp, Bos taurus; identical to SEQ ID NO: 80986

SEQ ID NO: 121591 - DNA, 201 bp, Bos taurus
ttggattttctatgagataaggctttctactatcccaaggtttaaaagtttagacattgtagaaaagaggactttgtgaggccccagatggtagaagggcrtagtgatgcccttaggattctcccttgcaggtcgagtctggtagggttccaggtgactctatccaaggccgtgacatcagccaccatgcaggtatctccc

SEQ ID NO: 121592 - DNA, 201 bp, Bos taurus
aggccccaactcccccagtgactttcagggaagagtttttaaagatggggtgtggctgttggtaggaatataaggtgcagccaccatggaggatagcatgraaggcccttaaaaaactgaaaatagagctactctgtgatccagcaatcccactcctgggcatatatcaggagaaacccacaactcaaaaagatccatgca

SEQ ID NO: 121593 - DNA, 201 bp, Bos taurus
cagggactccctggtaccagtgctttgatgagacgtcatctggagccctggaggggtgggaggcttttacatacagccctcatatcggccagtggcgtttyggggaacaaggaaacccagcaggcaggagccccctgggcagacccctgcactcccggtgagcacagactccccagggcacactgcaccctgctcctcacc

SEQ ID NO: 121594 - DNA, 201 bp, Bos taurus
ctgactccagcagctgtaggtagagggctgcttttgtaaacggaagaaaacttttcccaggccctcccacagaccctccttcatttctcttagccaagctracatttctctccaaatccacgcccattgagagagaaagaccattcagtgcagcaattcgacttctgggtaaaagcccggaagaactgaaggcagggctct

SEQ ID NO: 121595 - DNA, 201 bp, Bos taurus; identical to SEQ ID NO: 80987

SEQ ID NO: 121596 - DNA, 201 bp, Bos taurus; identical to SEQ ID NO: 80988

SEQ ID NO: 121597 - DNA, 201 bp, Bos taurus; identical to SEQ ID NO: 40655

SEQ ID NO: 121598 - DNA, 201 bp, Bos taurus; identical to SEQ ID NO: 40656

SEQ ID NO: 121599 - DNA, 201 bp, Bos taurus; identical to SEQ ID NO: 40657

SEQ ID NO: 121600 - DNA, 201 bp, Bos taurus; identical to SEQ ID NO: 40659

SEQ ID NO: 121601 - DNA, 201 bp, Bos taurus
gtcatgcgcggttcggtcaacgttgtgcttggaaatgtcccgtctacgtgatggcgagtttgatgtgttcacctgcaggcctgcaagacccaggcatctamgcagacacagatccagctgtagctccagagctctgggaggaagtggggacattgcacggtccgctgacttctgtaaaggccatgatcctctctatcagct

SEQ ID NO: 121602 - DNA, 201 bp, Bos taurus; identical to SEQ ID NO: 40660

SEQ ID NO: 121603 - DNA, 201 bp, Bos taurus; identical to SEQ ID NO: 40661

SEQ ID NO: 121604 - DNA, 201 bp, Bos taurus; identical to SEQ ID NO: 40662

SEQ ID NO: 121605 - DNA, 201 bp, Bos taurus; identical to SEQ ID NO: 40664

SEQ ID NO: 121606 - DNA, 201 bp, Bos taurus; identical to SEQ ID NO: 80992

SEQ ID NO: 121607 - DNA, 201 bp, Bos taurus; identical to SEQ ID NO: 40667

SEQ ID NO: 121608 - DNA, 201 bp, Bos taurus
cggaagtaattacaggcaaaaatgacatgacttctagtcctctcttaaaattctccaggaaaataaaacaacacattcttcctctcaaatctcttcaattrtaacaagatcatcaaaatgttgataactgcaatggcaccccactccagtacttttgcctagaaaatctcatggatggaggagcctggtaggctgcagtcc

SEQ ID NO: 121609 - DNA, 201 bp, Bos taurus; identical to SEQ ID NO: 80995

SEQ ID NO: 121610 - DNA, 201 bp, Bos taurus; identical to SEQ ID NO: 81000

SEQ ID NO: 121611 - DNA, 201 bp, Bos taurus; identical to SEQ ID NO: 81002

SEQ ID NO: 121612 - DNA, 201 bp, Bos taurus
gctgctgcaccgcgtcacgcgtcccaccggccagtgcctccacgccctcgccccggtttttgcttctttcgacaatagctatctcaaccattcattctgcrcctgagcgcggccgagcccgagggtaaccctgatgctcactctggaggcttctgctgtcactgagccgtgtcccgctggacctcagcccaggagggcaga

SEQ ID NO: 121613 - DNA, 201 bp, Bos taurus
ctcccatttggcctgggatgtgggattcttcatgcttgaactagggtggtccaggacaaaacagagctgtcggttatccggcaggaagctgccacgtgctrtgagtgagtgggtgggccacgttctaggagagctttcttgtttaaaagagatggcggtggggtctgacctgaaggccacagtgtgctgctgctgctgcta

SEQ ID NO: 121614 - DNA, 201 bp, Bos taurus; identical to SEQ ID NO: 40676

SEQ ID NO: 121615 - DNA, 201 bp, Bos taurus
ggtgggtgagagagcggctggcgtcgcggccctgagtcggaggccgcgggaggctgcagggtccatgcgtgctgccagccagagtgaaggtgggcctgtcrgtgaccgtggtcgccacgtaaggacgaaaggagcagggcggtgtggttcacctgcgagttcagagggtgcgcctggaggaccgagcgtggccgcggttcc

SEQ ID NO: 121616 - DNA, 201 bp, Bos taurus; identical to SEQ ID NO: 40677

SEQ ID NO: 121617 - DNA, 201 bp, Bos taurus; identical to SEQ ID NO: 40678

SEQ ID NO: 121618 - DNA, 201 bp, Bos taurus; identical to SEQ ID NO: 40679

SEQ ID NO: 121619 - DNA, 201 bp, Bos taurus; identical to SEQ ID NO: 40680

SEQ ID NO: 121620 - DNA, 201 bp, Bos taurus; identical to SEQ ID NO: 40682

SEQ ID NO: 121621 - DNA, 201 bp, Bos taurus; identical to SEQ ID NO: 40683

SEQ ID NO: 121622 - DNA, 201 bp, Bos taurus; identical to SEQ ID NO: 40684

SEQ ID NO: 121623 - DNA, 201 bp, Bos taurus; identical to SEQ ID NO: 40685

SEQ ID NO: 121624 - DNA, 201 bp, Bos taurus; identical to SEQ ID NO: 40688

SEQ ID NO: 121625 - DNA, 201 bp, Bos taurus; identical to SEQ ID NO: 40689

SEQ ID NO: 121626 - DNA, 201 bp, Bos taurus; identical to SEQ ID NO: 40693

SEQ ID NO: 121627 - DNA, 201 bp, Bos taurus; identical to SEQ ID NO: 40694

SEQ ID NO: 121628 - DNA, 201 bp, Bos taurus; identical to SEQ ID NO: 81015

SEQ ID NO: 121629 - DNA, 201 bp, Bos taurus; identical to SEQ ID NO: 81016

SEQ ID NO: 121630 - DNA, 201 bp, Bos taurus; identical to SEQ ID NO: 40697

SEQ ID NO: 121631 - DNA, 201 bp, Bos taurus; identical to SEQ ID NO: 40698

SEQ ID NO: 121632 - DNA, 201 bp, Bos taurus
gaatagcttaaaaaaaaaaagtataatacttttcagctttctacatgagaaatacttttctaagtgtcaatataaaagtagcataagagtgttttcaaaarccagtaggtaaaaccagatattatgtgagagtattaacattagtgatgaccattcaataaattaattataatcaattggtgagctcaatatagtctttaa

SEQ ID NO: 121633 - DNA, 201 bp, Bos taurus; identical to SEQ ID NO: 81020

SEQ ID NO: 121634 - DNA, 201 bp, Bos taurus
attttcctctgcacctagaactacaatacttttttcaaactaatttttcttttgacaacttttgttatagacacgaaaagtcaaatataagtaaaacataraaagaattaaaattggaaattataataagaactaaattaattttaccttcaaaatcttgacattttaaatctacatcatatgcaagcaaacaggtgtcaa

SEQ ID NO: 121635 - DNA, 201 bp, Bos taurus
tgtgaaaatagcacagagtctaagtctataacagagttatagcttaaagaacaactgaagtaataccttttggttcatcaagacagtctcattatggaagyggattgggaagaaagcgggccaggggcttcagtaagcagggagtaagttgccccagtacctaaaggaaatcgatggattggccccctacagttactaata

SEQ ID NO: 121636 - DNA, 201 bp, Bos taurus
aaaataagtcattcaatcaaaatcttgcagactagcaattatcttaccatggacctattttttagactagtaggttgaaattcatattataatggatttgyaaatgaaatatgaagagctaaagtaaagagtgggtttttagatggtgctagtgcattggagaaggaaatggcaacccactccagtgttcttgcctggaga

SEQ ID NO: 121637 - DNA, 201 bp, Bos taurus; identical to SEQ ID NO: 40699

SEQ ID NO: 121638 - DNA, 201 bp, Bos taurus; identical to SEQ ID NO: 40700

SEQ ID NO: 121639 - DNA, 201 bp, Bos taurus; identical to SEQ ID NO: 40701

SEQ ID NO: 121640 - DNA, 201 bp, Bos taurus; identical to SEQ ID NO: 40702

SEQ ID NO: 121641 - DNA, 201 bp, Bos taurus; identical to SEQ ID NO: 40703

SEQ ID NO: 121642 - DNA, 201 bp, Bos taurus; identical to SEQ ID NO: 40706

SEQ ID NO: 121643 - DNA, 201 bp, Bos taurus; identical to SEQ ID NO: 40707

SEQ ID NO: 121644 - DNA, 201 bp, Bos taurus; identical to SEQ ID NO: 40708

SEQ ID NO: 121645 - DNA, 201 bp, Bos taurus
ttcctttcttatgtggcatacttcacagaacttgctgtcaactttcttctccccttttatacaggacacgaggagatggtagggagttgtagacatgtttrgtaggagatgaacctttttataatttatagtcaaatttgtcctccagaagatttttatatatataccaaaacatcatcttcttacctgaaatcagtccag

SEQ ID NO: 121646 - DNA, 201 bp, Bos taurus; identical to SEQ ID NO: 81032

SEQ ID NO: 121647 - DNA, 201 bp, Bos taurus
agagatggaggttttgtttccctagtacacatggagagctgcttctgctggccttgaagaagcaaacagccatgttataaagtgactaaaaggagggccaygaggcagaggaaacagtgagcagcctctagcacctgaatacagccaccagccagtggtcagtaagaggtaaagccagggcctgggccctcagtcatatat

SEQ ID NO: 121648 - DNA, 201 bp, Bos taurus
gtttattgagagaaatgatgacttttttcatttccccaggctcaaatgatacaggtaatctagggaattaaaattagcaaatgtttctatactaagtctaraagtttcatcttttcccagccagaattctattcttgggagagtaggcaatctaggattcaaattttgccttctctggagttttaagattaaatcctagta

SEQ ID NO: 121649 - DNA, 201 bp, Bos taurus; identical to SEQ ID NO: 40713

SEQ ID NO: 121650 - DNA, 201 bp, Bos taurus; identical to SEQ ID NO: 40714

SEQ ID NO: 121651 - DNA, 201 bp, Bos taurus; identical to SEQ ID NO: 40716

SEQ ID NO: 121652 - DNA, 201 bp, Bos taurus
tgtttttgaatatgaatgtgacagcattgtcttaagcactggttttctgtttggtctgaagatctcatttttaatataaagttggccggagctacttacargttttaaatgcttcacagagttgtgctgtagaaattaaaatgtatgaaactttcattactatttaaattacttttaggccttttgtaattaaggaaacaa

SEQ ID NO: 121653 - DNA, 201 bp, Bos taurus
gctttgtgcacttaattgggtgttatctaaataatgtctcatagaggcctttgaggtagaaatcattattttcccctttgcagagaagagtttcctataaytttgagaggctcagaaattttcacaaacatacagatgccagtggtggaaatttaattagaatctacatctatgagctaacagcaggttgggttcctaacc

SEQ ID NO: 121654 - DNA, 201 bp, Bos taurus; identical to SEQ ID NO: 40718

SEQ ID NO: 121655 - DNA, 201 bp, Bos taurus; identical to SEQ ID NO: 40719

SEQ ID NO: 121656 - DNA, 201 bp, Bos taurus; identical to SEQ ID NO: 40720

SEQ ID NO: 121657 - DNA, 201 bp, Bos taurus
ttcacaggtacatttggatcatctcagtggaacctaaaatagaacgtgagttctctgctaagtctgtactgtgttgcacggctatttttggttcctaatgycccactctcttctcaagctgtttttcttttaaaaagaaagtatccttatcctctcaaaatttctaaaaggttgaaattagcagcatccgcacctctttca

SEQ ID NO: 121658 - DNA, 201 bp, Bos taurus
ataaacacaccttttcacctacatattgtctctggttggtttcaagcttcagatgtagagttgaattattgttacagagatcttatggcctgaaaagcctraattattgatagactctctaaccttttacagacagtttttaacctttgtactaaagtgatggccagtgtgaccaaaggcacgtgaaatagcagtaagaaa

SEQ ID NO: 121659 - DNA, 201 bp, Bos taurus
ctttcttcctccttcttagcttctttctctttgttaaagggagcagatctgttgtcatttaattttgcctcactgggaaaacactgaataaatgtcatttmtgatgagtgttgccaacattcttggaggcactgctcttgaatttttagtaaggattcctcattcttgaggatagtgtatgtgtgtgtgtgagtgtaatga

SEQ ID NO: 121660 - DNA, 201 bp, Bos taurus; identical to SEQ ID NO: 40723

SEQ ID NO: 121661 - DNA, 201 bp, Bos taurus; identical to SEQ ID NO: 40724

SEQ ID NO: 121662 - DNA, 201 bp, Bos taurus
tgttgaacttatgtgtaatgagagtgttccacaggccacagagaaagattattaaaggttagagggctcagaaggtctttcactaagctgcttatggcaawaacaagagattacagtgggccaggcattgtgctaagggctttctttctacataggattgcaatataattgtattaaccagaccacgacatccagagaatg

SEQ ID NO: 121663 - DNA, 201 bp, Bos taurus; identical to SEQ ID NO: 40726

SEQ ID NO: 121664 - DNA, 201 bp, Bos taurus
acagttctctcttcacccttctctccccttttatgatgagccctaaagttcatgtatctgagggttgggcatgcattgtgaaatttagtgtatcaatgtcyctgctcaaattactagaaatgctagaccaaggtcctgattactagtccttaataaacttggaatttattgcatacaatttctttgctataaagaaaagat

SEQ ID NO: 121665 - DNA, 201 bp, Bos taurus
cacatgggagcaactcagcctatgccccacaactacggagcccaggagcctcgtgcggcaaccaatgaaaccctcgcccctagaccctgcgctctgcagtkagaagcccgagcaccacaacaaagaccagcccccactcaccgaatctagagaaagtccatgcagcgacaaagacccagcatagtcaaataaataaataaa

SEQ ID NO: 121666 - DNA, 201 bp, Bos taurus
ttactccagccctactgttatacttctgtggaagagaggactatagtaatctaggtgactgccaaaggccatatcctctgtctgtctttgtgaacagagayggggagtcagcacataatttaggcttggtacaaaggagtgctttcttgcaagaggtgacatttgatccaattgttaaagattgaaagaaatagttggtta

SEQ ID NO: 121667 - DNA, 201 bp, Bos taurus
cagctaagtaacaacggcagtgtggcatgtgcacgccaaccctaatcccccagttcacccccacgccccctgccctgctgcgtccacgtgcctcttctccrcacctacgtctgccctgctgataggttcatcggtaccatttgtctagatcccacacaaagaagacgtagtacatatacacaacgcagtagtattcagcca

SEQ ID NO: 121668 - DNA, 201 bp, Bos taurus; identical to SEQ ID NO: 40729

SEQ ID NO: 121669 - DNA, 201 bp, Bos taurus; identical to SEQ ID NO: 40731

SEQ ID NO: 121670 - DNA, 201 bp, Bos taurus; identical to SEQ ID NO: 40733

SEQ ID NO: 121671 - DNA, 201 bp, Bos taurus
tcaaagacagatttaagtccctcgctggggaccccccaaagtagccagttccaatgctaaccttcatgatgtttctaattaggggttcacattgccttgcycatgaaaccacctcaatctaagcaggcaagaagagggttagtaactattgaatatatatcacatgccaagacctgtgccatgcacatttgatgcattagc

SEQ ID NO: 121672 - DNA, 201 bp, Bos taurus; identical to SEQ ID NO: 40734

SEQ ID NO: 121673 - DNA, 201 bp, Bos taurus; identical to SEQ ID NO: 40735

SEQ ID NO: 121674 - DNA, 201 bp, Bos taurus
gaatcaatcttccttgggggaaaaaaaagtgaggcatgtgctgtaaaattttctcaacgtgtatttctaacttgaaacttataacggcatgtttttctttkgggggaagaaaaaagcctaaaatcatgactgaatcaagtgagaagaaagtgagttcagagatgtctgtaatagaagacagacaatccatttgaaggcagt

SEQ ID NO: 121675 - DNA, 201 bp, Bos taurus
tctgcaatgagggagataaaatccagcactttgctggacagagtatatataataatacaggtcgactatttgacacagtggcatgtagactaggcagtcaracaatgttgtctgtccctctgagttgggactcaaaatctccaaacttgtggacaaactggtccgtaatttttctgtttaaattctggttaagttaaaata

SEQ ID NO: 121676 - DNA, 201 bp, Bos taurus; identical to SEQ ID NO: 40740

SEQ ID NO: 121677 - DNA, 201 bp, Bos taurus
tctgagaggcaaagaaaatgctggaagactttctgtcaaattttcctttggtttaaaaatctgaaactcattttctcctctgacccgtccccagctgcctrgggaaggaaaacacctggatacacaatgccaggagccactgtctgagcactcttacttttatacaattaaaaaaatttttattttatttatttttgcctg

SEQ ID NO: 121678 - DNA, 201 bp, Bos taurus
aaaataattttgcactcaacgcctggagaaacttgggtggaggcctccaccgagcttcttaaagattttgactcctgatattgagcagaggtcatgaactygagggctggaaaggcctggtgtgtgtatgaaagtcaggcagttataggggagaggaggggttagggggctttggacagcatttttctgtctaaagaggct

SEQ ID NO: 121679 - DNA, 201 bp, Bos taurus; identical to SEQ ID NO: 40742

SEQ ID NO: 121680 - DNA, 201 bp, Bos taurus
acagcagtctctgtgagcacactcttcagttaaacatattttacatataacatactgaatttactaatgtgcttgaatttttattttacaaatttcatcayaatctctctttatcagtgttgtatgtgatactacataggaaccacattctctaaaaacattagtttgagtgtatcttttgtagtctacagcaaattacat

SEQ ID NO: 121681 - DNA, 201 bp, Bos taurus; identical to SEQ ID NO: 40744

SEQ ID NO: 121682 - DNA, 201 bp, Bos taurus; identical to SEQ ID NO: 40746

SEQ ID NO: 121683 - DNA, 201 bp, Bos taurus
tacttcaaaagtaatgtatctatgtgtgaaatttatttctaccttaaaaaatataattttccattgaacttttaaaccttgattatatgtatatagttttyttctaggagatttcttctttttctccttctctggggcttgatttcaatgatttgggaaaaggaaagaacaagcaatgctctgaatgtgtaacaggtacaa

SEQ ID NO: 121684 - DNA, 201 bp, Bos taurus
tttcaccacagatatttcagtccaacccggtcctacattatcaggcaaacagcaccagacttcttgttaaattatttcagcattcccacaaagttaagagrtattttgagatggtaggatcttcacattctcaatttgcacaactctgcttcagctttcaatgttttgatctacctatagtgtagtgcagttcaattcaat

SEQ ID NO: 121685 - DNA, 201 bp, Bos taurus; identical to SEQ ID NO: 40747

SEQ ID NO: 121686 - DNA, 201 bp, Bos taurus; identical to SEQ ID NO: 40752

SEQ ID NO: 121687 - DNA, 201 bp, Bos taurus; identical to SEQ ID NO: 40753

SEQ ID NO: 121688 - DNA, 201 bp, Bos taurus; identical to SEQ ID NO: 40754

SEQ ID NO: 121689 - DNA, 201 bp, Bos taurus; identical to SEQ ID NO: 40755

SEQ ID NO: 121690 - DNA, 201 bp, Bos taurus; identical to SEQ ID NO: 40756

SEQ ID NO: 121691 - DNA, 201 bp, Bos taurus; identical to SEQ ID NO: 40757

SEQ ID NO: 121692 - DNA, 201 bp, Bos taurus; identical to SEQ ID NO: 40758

SEQ ID NO: 121693 - DNA, 201 bp, Bos taurus; identical to SEQ ID NO: 40759

SEQ ID NO: 121694 - DNA, 201 bp, Bos taurus
gccttgctaggacattatatagctttcagtgatcctctctcctgaatgttaaacacttgattgattgtctgccaggcatttatttagctatgataattcakagctgtctttagatagctttgatgaaatatctagttcctgtccttttgctttattttgtgttttatttgttgcatatttctggattcttttcttgaaata

SEQ ID NO: 121695 - DNA, 201 bp, Bos taurus
ctgttctatttctagcatattctggaactgctggtgggccagggggtaagggagtaactagctggatgactgtaataaaacagcaacaggcagcctcagaycagaaatttgcaatggccactccagccagcattattattcaaatccacatgtaacgcagtggggcctgatctgaaatttctgcctagtgggtgcctaacc

SEQ ID NO: 121696 - DNA, 201 bp, Bos taurus
aaaaattgatttgaagaaattatgtctgaaaatttcccacacccaaagaagaatacagtatcctggtatagccaccacagagggtccgaaacaagatgaayccaaacagacccacatcaagacatattagaccatctctacatttgaacattcaagttgtcaaccttcaaagatgtcaacatgtgttttatcaacgtggga

SEQ ID NO: 121697 - DNA, 201 bp, Bos taurus; identical to SEQ ID NO: 40762

SEQ ID NO: 121698 - DNA, 201 bp, Bos taurus
agatggcctgaaagtaatgggtctcttacagatgtgggggatggctgtggctcactgcagaggcaaagacactggtggaaacagttctgggaggtcctcaytggcctcttgaaggttaccactttcttaccaacacttggcaccagtgttggtgcctgtacactgaaactgttggtttcagcctgtagtttccagtgctgg

SEQ ID NO: 121699 - DNA, 201 bp, Bos taurus
tccatccaacagaaactagcccactggtcttggtgctatgtttccttccaacccactgatgagccttccctctctagggaagtgagggcaaagtttggagytgcacttaaccttgtgcccacatgaggtcaacagtggcctgcctctgccactcacagctagtggtcttcaggatccccatcaagttaactcagaattctg

SEQ ID NO: 121700 - DNA, 201 bp, Bos taurus; identical to SEQ ID NO: 40763

SEQ ID NO: 121701 - DNA, 201 bp, Bos taurus
gagttacttctccactgatctccagcaacatattgggcacctaccaaccaggggagttcatctttcagtgtcctaaggtttggccttatcacattgctcakggggttctcaaggcaagaatactgaagtggtttgccattcccctctccagtggaccacattttgtcagaactttccacaatgacccacctgtcttgggtg

SEQ ID NO: 121702 - DNA, 201 bp, Bos taurus
aatacaactctttcagaacctagtggtcaaaagtaagctaaggttatagaagaatttaataatacagtaaataagcttgatttaatagctacttaaatcartagatgaattagtgtatactagtttttggaagccaattgtgagtatctcatcccatctccatattcagtgttgtcacattagtaactagaaatagatcat

SEQ ID NO: 121703 - DNA, 201 bp, Bos taurus
ccctgccctattttacctcctcagtacctctaaaacctatccacttctgtctgtctccactgcccccactcttgaatcactctctctccactgattactgyaacgacctctaaatttgccctccacatctcttctccttcctaatccattctcttcatgcatccagggcaatcttttctttttaaaatttttaatgttaat

SEQ ID NO: 121704 - DNA, 201 bp, Bos taurus
cctcccctgttagccttctctgctggtttctcctatagagctcccgttcccaagctttactggttgtgttctctttgggctgtcatcctggagacaacccwctctccctggggaccattcgctgtcagcttgtcattatcagctttctaatcatttcttctcatgttctctcactttcttctttcattttgcttttatgct

SEQ ID NO: 121705 - DNA, 201 bp, Bos taurus; identical to SEQ ID NO: 40764

SEQ ID NO: 121706 - DNA, 201 bp, Bos taurus
aacagactgaaaactgcttctgcctggtgttagtcctttagttgctggatttggggaagttgtggaggaaccagagcctgtgagaaaaagagcacttgggrttggggccagcagctagttacccgtgggtacagaaggatgctgagagcaactagtagagttccactggtggtggagaatgtctcttgcttcattgagaaa

SEQ ID NO: 121707 - DNA, 201 bp, Bos taurus; identical to SEQ ID NO: 40767

SEQ ID NO: 121708 - DNA, 201 bp, Bos taurus
tgctgactgactgatacccctgtcttatggggtcaaacaacttgaatgtcttagtgaggtaaatactttaaaaaatggtggctgtcttttttccattaatratctcatgaataacctctatactcaaatatgggaaggaaagaagaacatttaatcactctaaacagttatattaaaaatgatcacaattccatggtagaa

SEQ ID NO: 121709 - DNA, 201 bp, Bos taurus
ctctctgttactgcctttcttctgtttcttctcggggcctccccttaagagcctagcttgaaaattacacatactgaataatgttttttctctttgcattycctaattctctgggacaccttctatctccaggaaaaaagtcctgaggtacagctgataaacccggagaaggcaatggcaccccactccggtactcttgcc

SEQ ID NO: 121710 - DNA, 201 bp, Bos taurus
tcacaccttcttgcctcctgagattgcaggaaggcccttggaattacctgtaaattttaattcctgaaaaaatttgtcctgggttctgaagcagatgggtrtgcattggcctggaagcttaaggatttcagtgggagatgtagttcttggcctcagtttcttcatctgttgaatgaagatggtctagttgacctacatgac

SEQ ID NO: 121711 - DNA, 201 bp, Bos taurus
gtttgtcatggccttgcctggtggctcagtggaaaaactccacctgccaagcaagagatgtgggtttgaatctgggaaatcccatggatagagggacctcrcaggccacagtctatgggaacatgaagagctggacacgacttggcgactaaacaaaaacatagatgtgccatagctttccttccgaggagcaagcgtctt

SEQ ID NO: 121712 - DNA, 201 bp, Bos taurus
gtgcttgttggtggactggagatgtctaatagctgttggaattaaatatttagaatttatagaggtctagctagagatacagattgagaatagtcagtgarcgtgtgtttgaagtcaattgacttgaaattgccctagagagctagaagaaaaaattgaaggatggagatagaaggaaaaagaatccagaaggatttctca

SEQ ID NO: 121713 - DNA, 201 bp, Bos taurus; identical to SEQ ID NO: 40776

SEQ ID NO: 121714 - DNA, 201 bp, Bos taurus
aagctagaaaatcacatacttgcttcaaagctgagatgtacagcataacattcaaaagctaaaatgtttttttgatctaagagagtagggccaaaacctgycaaaatgtatttatgtaccttaagggggaaaaaaaaagcatcggtcacaagaggcattggttagcaatgctacatgggagaaaggaaggatcttgtgaaa

SEQ ID NO: 121715 - DNA, 201 bp, Bos taurus; identical to SEQ ID NO: 40779

SEQ ID NO: 121716 - DNA, 201 bp, Bos taurus
tggccaccacgtagcaggttcttcaggcaaaaaagaagggggagaagagaaaggagggtgagacaaggaggtagggtgtttgtcactctggcattggcggrtggggtgggttagggggccaaaggggtggcaagagggactgtcacttctccgttctctcccatccctggtcgtctagtggtctgggacagcacaggtgct

SEQ ID NO: 121717 - DNA, 201 bp, Bos taurus; identical to SEQ ID NO: 40781

SEQ ID NO: 121718 - DNA, 201 bp, Bos taurus; identical to SEQ ID NO: 40782

SEQ ID NO: 121719 - DNA, 201 bp, Bos taurus; identical to SEQ ID NO: 40783

SEQ ID NO: 121720 - DNA, 201 bp, Bos taurus; identical to SEQ ID NO: 40784

SEQ ID NO: 121721 - DNA, 201 bp, Bos taurus
tgacagggttgttggttaaagtgttatctacatagtggtggtggtgctgctggctctgtggagtgatctgctgtggggcaaccccacagaaatatgctccrtggaacgtctccttcaggaggcctggttacatttgcacatgagttcagagctataacaaaatgcagttagcatttatgaattttattgctttgtaggaac

SEQ ID NO: 121722 - DNA, 201 bp, Bos taurus
gcctacattaaaatttttttcttatatgccttcatcaaaatgacccaattaatttatgtttgcacagctgtggagagaagaatgggtttgaatgggagacrttagtgaggattaatccttgctgactgactaaccatgatggtatcctcctcctccttctgcctgttaaaaaattaaaacctaccccttatccagttacac

SEQ ID NO: 121723 - DNA, 201 bp, Bos taurus; identical to SEQ ID NO: 40785

SEQ ID NO: 121724 - DNA, 201 bp, Bos taurus
tattccttattatagcgtaatatcttaaatgacacagatttaattggaaaagtcactgcataagtgtatttttatctactctaggaatatgaagcacggayagggagagcctgtaaaccaccacctcagtcttcaagacgaaagaattttgaatttgagccactttctaccactgccctgattcttgaggatcgaccatcg

SEQ ID NO: 121725 - DNA, 201 bp, Bos taurus
atcactctttatgtctttaactccatcgtatcctgattgctgaagccatctccccttcgaaacccctggatcctgctgggtctggcccccagtatggcagycttttccacagtgactacagtagtcatgttcccacgagcaatgtacaggggtcctgttgacccacatagtggccaatatgtattttataattttttgtaa

SEQ ID NO: 121726 - DNA, 201 bp, Bos taurus; identical to SEQ ID NO: 40787

SEQ ID NO: 121727 - DNA, 201 bp, Bos taurus
aaaaaggagcagggtgggtgggaatgtaatatgatctgtctctaacaaggtttcatgtggccgagggactcagagcatcacagaatttcagggctggaaargaccacaatttccaaatgttatgagtcttgaagtccagaccaatccatcaagatgagagaatactacaaccagtcacacacgctccctgaaacaaagaat

SEQ ID NO: 121728 - DNA, 201 bp, Bos taurus; identical to SEQ ID NO: 40789

SEQ ID NO: 121729 - DNA, 201 bp, Bos taurus
tactgacacagaccagatcctttgctgatttctggagatctaaaaacgtgtagtgttctcaaagtgagttagtctcatagaggagacggacacagacagaygccgaggagggtatttaatctgtcattagagaagggttaagagactttcaggaagacttcctggaagtggtgacatgtacactaattatcctcaactcca

SEQ ID NO: 121730 - DNA, 201 bp, Bos taurus
atccctccccccaaaatctggcagtcctaattagattgcctaactttttccatttcaccttaaattatatttagttgattatacactggccctgtactcamacactatacatatacatcccaagtttaatctccttgaatgaaaaggcaaatttgcacttatctagaatgtttagaggctggatttgaggccgaaaaggat

SEQ ID NO: 121731 - DNA, 201 bp, Bos taurus
acatattaaacagacattcaatatgcacccattagtgcaagttaacccctttaattttcagggtaaactgaatatttattatgcatgttttatgtgtgagratactggctcagagaggttaagtttcttacccaaggacaaaagttgctagatgacaaagccagactcaaacccagggccagcctctttccttatggcctc

SEQ ID NO: 121732 - DNA, 201 bp, Bos taurus; identical to SEQ ID NO: 40796

SEQ ID NO: 121733 - DNA, 201 bp, Bos taurus; identical to SEQ ID NO: 40797

SEQ ID NO: 121734 - DNA, 201 bp, Bos taurus; identical to SEQ ID NO: 40798

SEQ ID NO: 121735 - DNA, 201 bp, Bos taurus
ctaattatttccccttcacataattattttttcctacattaaacaaaaatatttttttctttcaattactgactgaaaaagcatattagcaacataacccratgagtacgtgtaatttttgtattatgatgacattttaatcattttcagtgtgaactcgttcccctccccgacaaaaacagattagcactaaaggcatat

SEQ ID NO: 121736 - DNA, 201 bp, Bos taurus
aaacagaaagagactcacagacttaggaaacaaacttatagttgcccgggggaagagacagctaaggacttcgggaaggtcatgtacacactgctctattyaaaatggatgactaataaagacccactgtatggcacatggaagtcttgctcagtgttacgtgccagcctggatgggaggggtgtttgggagagaagagat

SEQ ID NO: 121737 - DNA, 201 bp, Bos taurus; identical to SEQ ID NO: 40799

SEQ ID NO: 121738 - DNA, 201 bp, Bos taurus; identical to SEQ ID NO: 40800

SEQ ID NO: 121739 - DNA, 201 bp, Bos taurus
aagctttctttttagataactgaccttaaaaaatacaggcatgtaaaatggtggagtccttttccctaagacttgatggcatttaaaataataagcatagragagtggcatttgaatcaatgagttgcatcttgtcagctcttattagcttattgcttgaaatgtcagtaagccattggtagcagacatggctgtagctgt

SEQ ID NO: 121740 - DNA, 201 bp, Bos taurus
ggccggagaggaggcccttgcaggacccccggtggaagatggaggtacaggctctggagtctgtctcgcctcaaaccaaggctttaggcccaattcaatgrcttttcaaagtagcacaatgagggaagggagaggcgggaataggagggggcaaggaatggaggaagtgaggggtgggagttgacgggctggaggggaggg

SEQ ID NO: 121741 - DNA, 201 bp, Bos taurus
caatcgctaactcttaatgctttaagtagggtggtgggggtaggtcgcctgcgccatctagtggccgagatggtgattatcagcacttgtacctggacttyctcgtcaatggaatagggtagtgagatgtggaggctattgagttcttgaaatgtggtttatctgaattgagatgtgccgtagtgttcttgcctggagaat

SEQ ID NO: 121742 - DNA, 201 bp, Bos taurus
tagagcccacaggccaggaggtagagcccggctcagctctcaggcaccttcacattcttccctacccaggtcgttccctctcagttttaccactgtctgtytggttcccagttccagtcagggcctttcttatttagccatctttacagccctctcaggatcccaccttgctccatctctttatcttctcactatccaaat

SEQ ID NO: 121743 - DNA, 201 bp, Bos taurus; identical to SEQ ID NO: 40802

SEQ ID NO: 121744 - DNA, 201 bp, Bos taurus; identical to SEQ ID NO: 40803

SEQ ID NO: 121745 - DNA, 201 bp, Bos taurus; identical to SEQ ID NO: 40804

SEQ ID NO: 121746 - DNA, 201 bp, Bos taurus; identical to SEQ ID NO: 40805

SEQ ID NO: 121747 - DNA, 201 bp, Bos taurus; identical to SEQ ID NO: 40806

SEQ ID NO: 121748 - DNA, 201 bp, Bos taurus; identical to SEQ ID NO: 40807

SEQ ID NO: 121749 - DNA, 201 bp, Bos taurus; identical to SEQ ID NO: 40811

SEQ ID NO: 121750 - DNA, 201 bp, Bos taurus
ctttttcttggatcctctgggcatttcactgtgtagtcgtgataatttcctcttccttagaatcacccacttgttctggtacctcattggcaatgcagaargcatcaggctcaggtctttgcagcagagatcagggtgcagaccttggacacagttggaagggctaggctgcagagttgccccgcagggcagggctgatga

SEQ ID NO: 121751 - DNA, 201 bp, Bos taurus; identical to SEQ ID NO: 40812

SEQ ID NO: 121752 - DNA, 201 bp, Bos taurus
aaataactgttggagtagaaaaactaggacaactgacatgaatccactcacacagatggttctttacatttgaaaaccagcttttggcaacttggtgtttmgtgtctgtatgtttgccttttattttgcataaatgtatttttactcgagacatactactttcacgtaattgacatgcagagttcaaagaactagactatt

SEQ ID NO: 121753 - DNA, 201 bp, Bos taurus; identical to SEQ ID NO: 40819

SEQ ID NO: 121754 - DNA, 201 bp, Bos taurus; identical to SEQ ID NO: 40820

SEQ ID NO: 121755 - DNA, 201 bp, Bos taurus; identical to SEQ ID NO: 40821

SEQ ID NO: 121756 - DNA, 201 bp, Bos taurus; identical to SEQ ID NO: 40822

SEQ ID NO: 121757 - DNA, 201 bp, Bos taurus
tggcagcgcactccagtattgttgcctggagaattccatggacagagaagcctggagagctacagtccatggggtctcaaaagagtggaacacaatgtagygactaaaagtaacagacttaatagataatggcatattccctgggatataacatcctagttttttcggtttttatgatactaaggttgatcagtggattca

SEQ ID NO: 121758 - DNA, 201 bp, Bos taurus
gatgtgaagggttactctgcagagggaaaaacacaggtgaaaacggagtcatggttgtgactgcagggaaaccctttgcttggtcgctgcttccagtcctraaactcccatctttgatgctttacaaataagtaaacgaggtctggattatggaatcttgtgatttgaatggagttctggaacactgtctccatcggctgc

SEQ ID NO: 121759 - DNA, 201 bp, Bos taurus; identical to SEQ ID NO: 40828

SEQ ID NO: 121760 - DNA, 201 bp, Bos taurus
ggagagaaagagaatcagagtagtttcaactttttacaaaactacaaacttgggccagtttgaaaatatgaacattccataaagtgaacatgaattctttratttggtaacaagaacaaggtaaatcatatggaaagtcacacgcaaccagtgcagttaggttcaatccgaatggagttaagacagccacacgttcatcct

SEQ ID NO: 121761 - DNA, 201 bp, Bos taurus
aggttgtggcagggcctgggctcaccccatcaggaccccgcagtagctccaagctcctgttaaggaccatcactttctccatcaggtcctgaagggacaargaaaagggcagtcagtcctcatcaacccacaccctgctctcttagctcaggcagctcaaccaaggacttccctgctacagataccaggtgatgatacatg

SEQ ID NO: 121762 - DNA, 201 bp, Bos taurus
gctgtatttgcctttaaatgtgtatttgagaacctgtgtctacacaatgggagcacccatcatggtgtgtaagcctgtgtaagtgtggctgtgtatggccrtgtctgcacatagactgtaagccccacaggggcaagaccaagtgtcctctctatagctccatcacctaagaaagggcctggcacatagtaggtgctcaat

SEQ ID NO: 121763 - DNA, 201 bp, Bos taurus
attggcacctcactcattgctatgccccctgtgttgagtgcagagactggtgaacagaaggcacataggaagcttctttttcttctttcacctttccttcytacacaggaaatacagagaagaaagacaaaaataatgcccatataagttagacaaccccagttgctatttgaatgaccattcaccagacaactctttctg

SEQ ID NO: 121764 - DNA, 201 bp, Bos taurus
ctttcccaatcctgccctgtcttcctccaacaggcttaggttggcttatcaagaagtctgggaagagggagttcccttgtggcctcctggttgggattccrggcgccccaggttcaagccctggttggggaactgagatcctgcaagccacctggtggggccaaaaaaaaagccttgaaacagtatgatcaaaacaaagtc

SEQ ID NO: 121765 - DNA, 201 bp, Bos taurus
ggaagctttacttgttgaggtaggccaagtgcttggatatagctaggagctgaggaaaggaaatttagccaggcacatggaacatggtatctgtgggcaaytgaagcagatctggggacccagggaagtttataagggcaggatataatttcagagggagagaatagtgacaaggaatctgggtacagatagtctggggag

SEQ ID NO: 121766 - DNA, 201 bp, Bos taurus
tcctgattaataggtctagtttcaaggtggaaaggccttcatgacctttgagtatagtgttcagcttgagacagtccagctggtcttgcttggaccatcaratcctagttccctttggcctttcttagaggccactagggcagttccaggatgtgagagaaaactatagaaggaaagaggaaaacttgtagagaaatatgt

SEQ ID NO: 121767 - DNA, 201 bp, Bos taurus
tttaactaaattttgttctcctcagaatggcccaagtagagactggtgggagcaggacagagaggaacactccactcaaaccactgggccctttgaacagytgacccttttcttattcatctccaaccaccccaccccatgcctgccagcttgcaaaatactgtttgtttttaatttttaagtataaataatcccagggcc

SEQ ID NO: 121768 - DNA, 201 bp, Bos taurus
ctatcttcagagactgggcctctgggatttctttttacaaactgatgagagtaaaaattctgttggaaaccacaaggctcactctgccaggacagagtctrggccactctcagacccttccattttcaacaactatggggccaggcgtctgagaaataagcaatctaacaatactttcccagcacttatctgacttgaata

SEQ ID NO: 121769 - DNA, 201 bp, Bos taurus
cacgtgcatttacattgatgtgataccatcaccaccatccatctacagaattcttttcattttacaaaataaaagctctgcacctatttttttgagagggrccaacatagctccccactctccacagcacgcactttgacggactccaccacagtcaagggcagctgctggcccagccgagggcccttcttcaggcactta

SEQ ID NO: 121770 - DNA, 201 bp, Bos taurus; identical to SEQ ID NO: 81146

SEQ ID NO: 121771 - DNA, 201 bp, Bos taurus; identical to SEQ ID NO: 81147

SEQ ID NO: 121772 - DNA, 201 bp, Bos taurus; identical to SEQ ID NO: 81148

SEQ ID NO: 121773 - DNA, 201 bp, Bos taurus; identical to SEQ ID NO: 81149

SEQ ID NO: 121774 - DNA, 201 bp, Bos taurus; identical to SEQ ID NO: 81150

SEQ ID NO: 121775 - DNA, 201 bp, Bos taurus
ggaagccccggccttgattctcttctgggtttaggctgttccaggcctgtgaatgtcagttcgtcagccactaactatatctactctcggccttgggttcrtttgacaaatatttgctgaaggcctcctaggcccagcctccctgctgcatgggccccggcatctctttgagtttctgccaacatgctattagcaaggaca

SEQ ID NO: 121776 - DNA, 201 bp, Bos taurus
ctgtcggctccagccctaggtgggtccagagctggacttcgtgggtttgcagcacatcctcctcagtattctacagcagctgtctggagttttttctgccrtgcctgaactgatgtcatttcccccttggcagacagcttcagctttgctgcgtctgagatatgtcacgagaaggtgggggtgggtcagagccaggcgggg

SEQ ID NO: 121777 - DNA, 201 bp, Bos taurus
ggtggagaccataccagtcccttgaaagcacaaaactgatttgatgaacaagaatttcaagaaacaccctctattgtccagtttcctatattttcagccgrgggcaaaaatcaaggtttagctcaggagaaggagcaggaagtgggtttggctgactgttgaaacctgctggaaacctggttttcattggaaagggctgtg

SEQ ID NO: 121778 - DNA, 201 bp, Bos taurus
tcttcacataactaacttcctaccctcatactccttgccaggattctaacacacattgggttatatattagttctttaggttgttttggaagcatttgtcytagaattgccaacagtaactatagaactgtagcagcctgttgctctgaatcttcccttcacaaattaacctaaaaattatcttttttcctatgtttaaat

SEQ ID NO: 121779 - DNA, 201 bp, Bos taurus
cctttcgtgtggtctagaaggaaaggccctccatcatgcttctttgtgcatacccaacagagctcagaagccccagatacgatggtctttctgatccatcrctgcccaggcctcatctttcaaaaccattgcctttgtgaagctcctgtgactctctgtgagctggccttctgctctcctgccctcatgctctccctgcac

SEQ ID NO: 121780 - DNA, 201 bp, Bos taurus
ctggctgttatcctcattaaaattcgttttcaaaggctccggtgagcggcctgctaaagataaactatcaggagagaggccttcaaagaaagtgctttaakgatgcaattatcttcaatcaactcagaacatctttattgcattagaaaagggcaatttatctcggaatgcagaaagaggtggtctagcctcagacacagg

SEQ ID NO: 121781 - DNA, 201 bp, Bos taurus; identical to SEQ ID NO: 81153

SEQ ID NO: 121782 - DNA, 201 bp, Bos taurus; identical to SEQ ID NO: 81154

SEQ ID NO: 121783 - DNA, 201 bp, Bos taurus
tctttgcttttctatggcaggaacaagttttttctctctctctcacacacacatacacacacacattcaattataagtaccatctccaagtgttcgacaaycggctgaaggcttttgcctgttgtcagtacaggtttcaaactctccccagggatgccctttactgagcaaagcatgaggaatgaagaatgactagctgcc

SEQ ID NO: 121784 - DNA, 201 bp, Bos taurus; identical to SEQ ID NO: 81157

SEQ ID NO: 121785 - DNA, 201 bp, Bos taurus; identical to SEQ ID NO: 81158

SEQ ID NO: 121786 - DNA, 201 bp, Bos taurus
agaaggatgttttgcttccttattaacatatctgcctccttttgaagctcttctagaattatctggcaggcaggagtgctctcagctctggtctttcctgrcgcaactaaactcctatatgtttccccaaatcaattattttatattaaatgtgtctgccctctctgggatgatcatatcactaataaagtatgtatactt

SEQ ID NO: 121787 - DNA, 201 bp, Bos taurus
ctatcccagtagccttgtatgttttgtccagtttgtatggtttgattcgctttctcttagatgtcaagtaaagtacttggttggcacataattaaaagatmaataattctcctaaagtgaaacaagaatgttctttttcagttctgacgttagctgatgtttctccaagagtgatttttggttggtactttccaggtacaa

SEQ ID NO: 121788 - DNA, 201 bp, Bos taurus
ttcataaatggccaagaaacttcacccataacaatgtgtacattttctgttttattccttttaattttcttctcatggttttggaaatttacttgcttacratttatgtattccctggtggctcagatggtaaagaatcaaccttcatagagttgaatgcagtacatatccagattgataataatctgggattccctggtg

SEQ ID NO: 121789 - DNA, 201 bp, Bos taurus
gaatcttgccttcccatggaaggtgtggccgtggaagatccccatggtaccaagacctgtgtgccgatgcagtagcctgacatctgtgtgtgactatgctyctgcatctttggcccagtgaattccttgcagttagacgattcctctgtgtctgattagaggtgttggcagtgatgatgcaagagcagggagaatcatggg

SEQ ID NO: 121790 - DNA, 201 bp, Bos taurus
agtgtgtcaggcacagtcaggcttgtataacataactctgcctcttgatcatagttgtaggattcacatttgagcatttcttcaaaatctttttttctccrttttactacatgcattttaatagaaaaaaaatagtctattgttagaattcggcagaatctcagaatgcaatgaaaacaaaagatggaaagagaaagaaat

SEQ ID NO: 121791 - DNA, 201 bp, Bos taurus; identical to SEQ ID NO: 81160

SEQ ID NO: 121792 - DNA, 201 bp, Bos taurus
gctgaaatagaggagctgattcaggccataccttgggcaaagcatatttggggagcttcatctgggcaaacgcattccttcggtaggacacgtagtaatgyggccgtccccctgatgtcagctgcaacgtaagcacaaaggtggtaaaaggagtcactaccagttacaggtcacagaagaatagtccctgcccggaagggg

SEQ ID NO: 121793 - DNA, 201 bp, Bos taurus; identical to SEQ ID NO: 81163

SEQ ID NO: 121794 - DNA, 201 bp, Bos taurus
ggacatgggcatccacagggtggggagaagaagctggctgtagaggatgggagaaaagtgattccttctgctcatggtcggggcagcaggtaggtctgcaragctgcccaaggaaagggccttgccagtctcaataagccaagccagagggtttctcctccccagcaaccaggcagtctgagcccggggagtgttcacatt

SEQ ID NO: 121795 - DNA, 201 bp, Bos taurus
ttcatcacttccttaaatctcagagatgccccaaatacatctgtgtgttcaggacgtttattccatacagtggccgagtgcctaccacagctgtctttctkctaggggcataaggagcccagtcttaatgtcaaagggacacatggagagaaacaatctaatttcatatcaaattttccactgtccagtagagggcagctg

SEQ ID NO: 121796 - DNA, 201 bp, Bos taurus
tatggaacaaacctgtgtagcctacaaaggaagaagagactgagggagctgtcgattggacattttccaccaagaaaagcagttgctcttcagtttcaaasatagttacacctagttttgatatttataataccagcaagacaaagcgttctaaacagataagatgagcagtgacttgttattctctcatgttatgaagaa

SEQ ID NO: 121797 - DNA, 201 bp, Bos taurus; identical to SEQ ID NO: 81164

SEQ ID NO: 121798 - DNA, 201 bp, Bos taurus
gccatgtcctcttccaggagatcttcccgacccagggatggaacctgggtctcctgcactgcagcagattctttaccactaagtcaccagggaagctccayagattcatggcaacactggcaaatgactgatttattttgtgggtcctgtctaagcacttgtcttcagagtctttcatttatagtattttatactgttctt

SEQ ID NO: 121799 - DNA, 201 bp, Bos taurus
tctccctcccctgacttccattccatatctttgatgggctattccttctcatgcctgtaagctgccacatgtgtcaatccttacatagggatttctacatktctacatagcacattttctactttttttttttcacctgaaaactcttatctatccctttttgtttactaaggacacaatatgctacctcttcttggaagt

SEQ ID NO: 121800 - DNA, 201 bp, Bos taurus
tgcacacaactaataaattctacacacacatatgcatccatagttgtttgacaaattactcaagagcagggcttttcatacgtggcctccactggcattcrgtgtacgtatatgagtgcttgattctgatatgtaggttgtgctcctttaccatgttcctcacggtgataatatagaatgagggccactataaatatactt

SEQ ID NO: 121801 - DNA, 201 bp, Bos taurus
gccacatactcagggccacagacagaatcaacagggtcagtcaaggggcaaaggagtcgatcttagggataaacacagtctctctcaatctctttctctcrcttatgcacatacaggcccaatttctttctgaaatacttcaaaggaatttggagatatattcatttacctttaaatgcatcagaatatatttcttaaaag

SEQ ID NO: 121802 - DNA, 201 bp, Bos taurus
gaactttgacataatcatctgtctcctgtcatatcaactcaattgggaagccattcctgatctctagccattttccaacatgtatttagtattttcatgcytttcagctatttgcttcattgttattctagttagactcaaggatgttaaagaggttataagccacttgccagtttctataagttggcagtatttgcatga

SEQ ID NO: 121803 - DNA, 201 bp, Bos taurus; identical to SEQ ID NO: 81169

SEQ ID NO: 121804 - DNA, 201 bp, Bos taurus; identical to SEQ ID NO: 81170

SEQ ID NO: 121805 - DNA, 201 bp, Bos taurus; identical to SEQ ID NO: 81171

SEQ ID NO: 121806 - DNA, 201 bp, Bos taurus; identical to SEQ ID NO: 81172

SEQ ID NO: 121807 - DNA, 201 bp, Bos taurus; identical to SEQ ID NO: 81173

SEQ ID NO: 121808 - DNA, 201 bp, Bos taurus; identical to SEQ ID NO: 81174

SEQ ID NO: 121809 - DNA, 201 bp, Bos taurus; identical to SEQ ID NO: 81175

SEQ ID NO: 121810 - DNA, 201 bp, Bos taurus
gtttccttcttctagagtttgggctaggcttagtaacttgcttctaataagtaaagcatggaaagagaaaaattgtaactttacagtgagatacccagcakgtacaccatttgccaaatgacaaagggcaataacactcatgttaagtaatgctgatgtgagatattccctgatgtgatatacgtagggcacttcacttat

SEQ ID NO: 121811 - DNA, 201 bp, Bos taurus
catgtgtagaggccatccaagtgtcaagcacatttggtggtgaggagcggggagtgagaagatgctgagttcccctgtggccatgtggcctaacaaagaayatcagcagaaaatgtccttgctcttgttatgcaattacagataccattagaagagtaagtgaaagcaaaagcacctacggtaacttaaatatctgttgtc

SEQ ID NO: 121812 - DNA, 201 bp, Bos taurus
tatccagttaaaattgtcttagttggattcactgtcactctatgacagccatcttcctttcctcctgttgggtttttaatatttatcttcattaactttaycctgaatgcacacacaaggcattcttggttgaagacagactttttattaattacttcacagtaagtaatgtgtactgcctctcccttccccacttcttac

SEQ ID NO: 121813 - DNA, 201 bp, Bos taurus
cccttagaggaatctcatcaggattccaagattctagtgacacagagtttggaaaaggctcccatgtattagggattgcaaccccttttccttctataagraggcctaaattttacttacctttaattctgatcattctgagtccaatgtcagtattctagcattaggaatagttattgactgtacatgtgaaaactcagc

SEQ ID NO: 121814 - DNA, 201 bp, Bos taurus; identical to SEQ ID NO: 81180

SEQ ID NO: 121815 - DNA, 201 bp, Bos taurus
gtggattttcatttttagaagctgcacttagtcaacagaagtttaggtaagaactgtaagcaagaaagaagccctgttcaaacctattccccaaaactatmaaaatcatccatttacaatcaagtcagaatgtcagcaattgtcacagctttctgttatctgacttgctttccctgtatctttacttttagaaactgcccc

SEQ ID NO: 121816 - DNA, 201 bp, Bos taurus
tttacatattaggaaaatcagctatttccaatatgttacaatttaatttttagtttgactgttgtcttttgattttgattttatgtaaaataaattcatayttagagggcctcttccacatcaagattttatgtgcatgtgtatatatatatatatataaagactgctattttctgagactgaataaaacatcagaagttg

SEQ ID NO: 121817 - DNA, 201 bp, Bos taurus; identical to SEQ ID NO: 81181

SEQ ID NO: 121818 - DNA, 201 bp, Bos taurus; identical to SEQ ID NO: 81182

SEQ ID NO: 121819 - DNA, 201 bp, Bos taurus
gggccatctctgacttacgtttcataactctgggtggcggactgttctgtgaagataactcctgcatagaactcacacacctcttactgcctcagctttgktttgttttttgtctaggccttttttctccccttgacttttgctccttctgttgaatctcttgtactgtttggttgcccctcaacatctgggttttcttta

SEQ ID NO: 121820 - DNA, 201 bp, Bos taurus
tcataggtgttttgaatgtttacatgtggatttgttacagggcaagctactggctttttctgcctattgagtattttggggggtacagtcaattcagaacrtatcctgggatgactcttagatggtatcatccatttaagtttgatggataaacaaccttgctgatgaatgcagttgctcacctgtcgtagcaatcctgat

SEQ ID NO: 121821 - DNA, 201 bp, Bos taurus; identical to SEQ ID NO: 81185

SEQ ID NO: 121822 - DNA, 201 bp, Bos taurus; identical to SEQ ID NO: 81186

SEQ ID NO: 121823 - DNA, 201 bp, Bos taurus
tcacctggagaggtccccggagaggccagggtctccaaaaagcccagcagacctgcacccaggacccttcaggaccatcctgatgatgcctctgatgctcygtggcttcctggggccttgggcacgcacggaccaggccatctggggaaagaggaagacagcagggctctggccaccagcggaggaggtgggggagggtgg

SEQ ID NO: 121824 - DNA, 201 bp, Bos taurus; identical to SEQ ID NO: 81187

SEQ ID NO: 121825 - DNA, 201 bp, Bos taurus
aataattatcaatatgtatgttcttattaccattttctcacttgttttgggtttgtttttaataggcctttttccttcccttcctcttctgttctctttcygtttgatgaccatttttgtgtgtttggactgctttttcttttttgtctgtttatcgtagttttgggatttgttgttcccatgaggttttgatatagcagt

SEQ ID NO: 121826 - DNA, 201 bp, Bos taurus
aatatggatatttttctaatgtaggcttgaaagagaatgaaagcgtgtgctgcctaaattaatttgttgtgaaaacaaaatcacttcattctccagattcyttcaaacacttgatgtttcctctagttttctggctctcatccttcatgacccatctcttttctgggaactttttcttggcttagaatcctagcgttgctc

SEQ ID NO: 121827 - DNA, 201 bp, Bos taurus
tgcttaaaaaaaggtgaaggattctgacaaggacgaaatcattgctaatttggtgtcattcctcatttcctgtggattgaaaagttggccttttacagaargaacttgagtgtccccaagctactggataatttctctgttcctgattttatgtctaggagaactgtgattctctgaggggcttggatgaccacctttgct

SEQ ID NO: 121828 - DNA, 201 bp, Bos taurus
tggcctttctttgtgatgagcagccatgctggcctgcagcttctatgtggaccaaggtacaagccctggcagaggtccaaggggccatggattcagagccyggcatccagtagaagcccattgagagatgactttcagcagcagaaagatatgcatttcctctacacagcaatctggcccctgcaaaagcctgaaccaaga

SEQ ID NO: 121829 - DNA, 201 bp, Bos taurus
atatttaggtaatttcttttacagtggctgattcttgtgtgccaatccatgcccttgtaacagcagggtgcttatcttccccaggctgctctgggatgctraatcatcataatagccccacttactgtccttgctctctgtaatgaagacagttaggaaaacctttccctacccccagcaacatcttttctcctgtggcct

SEQ ID NO: 121830 - DNA, 201 bp, Bos taurus
tcaactgggaacatctgctgtcatgttaggagtgactaagtttgatatgacttttctcaatttagatatttaggctgatcagttctcgcttttttatcatktgctgtcaactggtcttacaaaccaaagcaaagaggcaggaaaggagacaaatttctaatactctaatggccaaaggatgacattacccatgaactcaga

SEQ ID NO: 121831 - DNA, 201 bp, Bos taurus; identical to SEQ ID NO: 81190

SEQ ID NO: 121832 - DNA, 201 bp, Bos taurus; identical to SEQ ID NO: 40830

SEQ ID NO: 121833 - DNA, 201 bp, Bos taurus; identical to SEQ ID NO: 40831

SEQ ID NO: 121834 - DNA, 201 bp, Bos taurus; identical to SEQ ID NO: 40832

SEQ ID NO: 121835 - DNA, 201 bp, Bos taurus
tggctcccagttactttgggaagagtctttcctaaaatggaggaaacagacagaaaccctgtcagcaaaatgatgcaacaaaaatttgctacttgaaaacrggccgatatttttaagtgaatctttgttgcagctatttctccctgaaggacaggaaaggtctgccttcacccctctagcacccacaaagggaacacattg

SEQ ID NO: 121836 - DNA, 201 bp, Bos taurus; identical to SEQ ID NO: 81191

SEQ ID NO: 121837 - DNA, 201 bp, Bos taurus; identical to SEQ ID NO: 81192

SEQ ID NO: 121838 - DNA, 201 bp, Bos taurus; identical to SEQ ID NO: 40836

SEQ ID NO: 121839 - DNA, 201 bp, Bos taurus; identical to SEQ ID NO: 40837

SEQ ID NO: 121840 - DNA, 201 bp, Bos taurus; identical to SEQ ID NO: 40838

SEQ ID NO: 121841 - DNA, 201 bp, Bos taurus; identical to SEQ ID NO: 40840

SEQ ID NO: 121842 - DNA, 201 bp, Bos taurus
tttagaagtatttctagactagggtaacctcactggctaaaatgcgtgtctgaacaagagccccgttgttcgttcaagccctgctgcactggcgggatgcrggcagcttggcctggggtggggcgggccccgattccctccaggacgccccatgccaagcccaggagagcgcttcccatccgtcgcctcgggtggtgggat

SEQ ID NO: 121843 - DNA, 201 bp, Bos taurus; identical to SEQ ID NO: 40842

SEQ ID NO: 121844 - DNA, 201 bp, Bos taurus
ggcagaactgcaaagttgtggcgattgcttggagatagcatcacaaggtttttttattctgtaagacgagaagcagcctgcctgtgcctgctggtctgaaygcagggcctgtggaaatgcctaagaaagatggaagattttagaggaaagtgtggtctttggaaaacataaaaatgagtagcaggccaccgcaggggcctt

SEQ ID NO: 121845 - DNA, 201 bp, Bos taurus; identical to SEQ ID NO: 40845

SEQ ID NO: 121846 - DNA, 201 bp, Bos taurus; identical to SEQ ID NO: 40846

SEQ ID NO: 121847 - DNA, 201 bp, Bos taurus
cggaatcctaaccactgggccagcagggaagtccccggcgtccacactcttgaaaacatcccatgtggttctgatgtgcaggtgaagctgagaatcattgmgtacagagaatctgaccctagaacaaatgatcgcatggtctatggcctggaaggtgccattgcagatccaccaccagtaggtagcactagagggaaatca

SEQ ID NO: 121848 - DNA, 201 bp, Bos taurus
aaaaataaaaaagttataaaaattaaatcacaataaaagagacatcaaaaggcaacatacttttaattgacacatgaaatgcaattagcaaagtaactacsataagtagaggaaggagagatcatttctagaaacagtgggcagggatgactgtcatgaaaaaatatatcagccagatcttgaaagctgaatccaataaga

SEQ ID NO: 121849 - DNA, 201 bp, Bos taurus
cacccacaggataagtgtcacaatcttttccaagggatctatcgaccctgagataagaatccctgccttagatgcttgccatatttgaaaagaaagctaakgttttatcatttcacagcagtcttagtaccctggagagcctctgtattttaagttgctcataaattgactgtggtcatatgtgttagtggcttccatgat

SEQ ID NO: 121850 - DNA, 201 bp, Bos taurus; identical to SEQ ID NO: 40849

SEQ ID NO: 121851 - DNA, 201 bp, Bos taurus
tggtcttttggccaagaaagagagcgagcaggctttttgctggggcttttattgtctgtgcctttgggtgtttctggcttctccagtaccccatttgggtmcttctttgggccccagggtagctcttctgtcttctgccttccttcagagttgctgtgtgtttttccatttaagcccaaggtgttcagttataattaatgg

SEQ ID NO: 121852 - DNA, 201 bp, Bos taurus
agcagaggaataaggatgaagacagactcacacaaaagttatatgggtgtggtgcgtggaacccagcaatttgaggcccacctctgttccagccacaagcycaagttcacaactcagacagaggctgggcaatggggctgtctgacgaactctacatcctctccagaaactcctaacaattcatgttttacaaggccaatg

SEQ ID NO: 121853 - DNA, 201 bp, Bos taurus; identical to SEQ ID NO: 81208

SEQ ID NO: 121854 - DNA, 201 bp, Bos taurus; identical to SEQ ID NO: 81209

SEQ ID NO: 121855 - DNA, 201 bp, Bos taurus; identical to SEQ ID NO: 81210

SEQ ID NO: 121856 - DNA, 201 bp, Bos taurus; identical to SEQ ID NO: 40855

SEQ ID NO: 121857 - DNA, 201 bp, Bos taurus; identical to SEQ ID NO: 40856

SEQ ID NO: 121858 - DNA, 201 bp, Bos taurus; identical to SEQ ID NO: 81212

SEQ ID NO: 121859 - DNA, 201 bp, Bos taurus; identical to SEQ ID NO: 40857

SEQ ID NO: 121860 - DNA, 201 bp, Bos taurus; identical to SEQ ID NO: 81217

SEQ ID NO: 121861 - DNA, 201 bp, Bos taurus; identical to SEQ ID NO: 40863

SEQ ID NO: 121862 - DNA, 201 bp, Bos taurus; identical to SEQ ID NO: 81221

SEQ ID NO: 121863 - DNA, 201 bp, Bos taurus; identical to SEQ ID NO: 40866

SEQ ID NO: 121864 - DNA, 201 bp, Bos taurus; identical to SEQ ID NO: 40867

SEQ ID NO: 121865 - DNA, 201 bp, Bos taurus; identical to SEQ ID NO: 40870

SEQ ID NO: 121866 - DNA, 201 bp, Bos taurus; identical to SEQ ID NO: 40871

SEQ ID NO: 121867 - DNA, 201 bp, Bos taurus; identical to SEQ ID NO: 40872

SEQ ID NO: 121868 - DNA, 201 bp, Bos taurus; identical to SEQ ID NO: 40873

SEQ ID NO: 121869 - DNA, 201 bp, Bos taurus; identical to SEQ ID NO: 40874

SEQ ID NO: 121870 - DNA, 201 bp, Bos taurus; identical to SEQ ID NO: 40875

SEQ ID NO: 121871 - DNA, 201 bp, Bos taurus; identical to SEQ ID NO: 40876

SEQ ID NO: 121872 - DNA, 201 bp, Bos taurus; identical to SEQ ID NO: 40877

SEQ ID NO: 121873 - DNA, 201 bp, Bos taurus; identical to SEQ ID NO: 40878

SEQ ID NO: 121874 - DNA, 201 bp, Bos taurus; identical to SEQ ID NO: 40879

SEQ ID NO: 121875 - DNA, 201 bp, Bos taurus; identical to SEQ ID NO: 40880

SEQ ID NO: 121876 - DNA, 201 bp, Bos taurus; identical to SEQ ID NO: 40881

SEQ ID NO: 121877 - DNA, 201 bp, Bos taurus; identical to SEQ ID NO: 40882

SEQ ID NO: 121878 - DNA, 201 bp, Bos taurus; identical to SEQ ID NO: 40883

SEQ ID NO: 121879 - DNA, 201 bp, Bos taurus; identical to SEQ ID NO: 40884

SEQ ID NO: 121880 - DNA, 201 bp, Bos taurus; identical to SEQ ID NO: 40885

SEQ ID NO: 121881 - DNA, 201 bp, Bos taurus; identical to SEQ ID NO: 40886

SEQ ID NO: 121882 - DNA, 201 bp, Bos taurus; identical to SEQ ID NO: 40887

SEQ ID NO: 121883 - DNA, 201 bp, Bos taurus; identical to SEQ ID NO: 40888

SEQ ID NO: 121884 - DNA, 201 bp, Bos taurus; identical to SEQ ID NO: 40889

SEQ ID NO: 121885 - DNA, 201 bp, Bos taurus; identical to SEQ ID NO: 40890

SEQ ID NO: 121886 - DNA, 201 bp, Bos taurus; identical to SEQ ID NO: 40891

SEQ ID NO: 121887 - DNA, 201 bp, Bos taurus; identical to SEQ ID NO: 40892

SEQ ID NO: 121888 - DNA, 201 bp, Bos taurus; identical to SEQ ID NO: 40893

SEQ ID NO: 121889 - DNA, 201 bp, Bos taurus; identical to SEQ ID NO: 40894

SEQ ID NO: 121890 - DNA, 201 bp, Bos taurus; identical to SEQ ID NO: 40895

SEQ ID NO: 121891 - DNA, 201 bp, Bos taurus; identical to SEQ ID NO: 40896

SEQ ID NO: 121892 - DNA, 201 bp, Bos taurus; identical to SEQ ID NO: 40897

SEQ ID NO: 121893 - DNA, 201 bp, Bos taurus; identical to SEQ ID NO: 40898

SEQ ID NO: 121894 - DNA, 201 bp, Bos taurus; identical to SEQ ID NO: 40899

SEQ ID NO: 121895 - DNA, 201 bp, Bos taurus; identical to SEQ ID NO: 40900

SEQ ID NO: 121896 - DNA, 201 bp, Bos taurus; identical to SEQ ID NO: 40901

SEQ ID NO: 121897 - DNA, 201 bp, Bos taurus; identical to SEQ ID NO: 40902

SEQ ID NO: 121898 - DNA, 201 bp, Bos taurus; identical to SEQ ID NO: 40903

SEQ ID NO: 121899 - DNA, 201 bp, Bos taurus; identical to SEQ ID NO: 40904

SEQ ID NO: 121900 - DNA, 201 bp, Bos taurus; identical to SEQ ID NO: 40905

SEQ ID NO: 121901 - DNA, 201 bp, Bos taurus; identical to SEQ ID NO: 40906

SEQ ID NO: 121902 - DNA, 201 bp, Bos taurus; identical to SEQ ID NO: 40907

SEQ ID NO: 121903 - DNA, 201 bp, Bos taurus; identical to SEQ ID NO: 40908

SEQ ID NO: 121904 - DNA, 201 bp, Bos taurus; identical to SEQ ID NO: 40909

SEQ ID NO: 121905 - DNA, 201 bp, Bos taurus; identical to SEQ ID NO: 40910

SEQ ID NO: 121906 - DNA, 201 bp, Bos taurus; identical to SEQ ID NO: 40911

SEQ ID NO: 121907 - DNA, 201 bp, Bos taurus; identical to SEQ ID NO: 40912

SEQ ID NO: 121908 - DNA, 201 bp, Bos taurus; identical to SEQ ID NO: 40913

SEQ ID NO: 121909 - DNA, 201 bp, Bos taurus; identical to SEQ ID NO: 40914

SEQ ID NO: 121910 - DNA, 201 bp, Bos taurus; identical to SEQ ID NO: 40915

SEQ ID NO: 121911 - DNA, 201 bp, Bos taurus; identical to SEQ ID NO: 40916

SEQ ID NO: 121912 - DNA, 201 bp, Bos taurus; identical to SEQ ID NO: 40917

SEQ ID NO: 121913 - DNA, 201 bp, Bos taurus; identical to SEQ ID NO: 40918

SEQ ID NO: 121914 - DNA, 201 bp, Bos taurus; identical to SEQ ID NO: 40919

SEQ ID NO: 121915 - DNA, 201 bp, Bos taurus; identical to SEQ ID NO: 40920

SEQ ID NO: 121916 - DNA, 201 bp, Bos taurus; identical to SEQ ID NO: 40921

SEQ ID NO: 121917 - DNA, 201 bp, Bos taurus; identical to SEQ ID NO: 40922

SEQ ID NO: 121918 - DNA, 201 bp, Bos taurus; identical to SEQ ID NO: 40923

SEQ ID NO: 121919 - DNA, 201 bp, Bos taurus; identical to SEQ ID NO: 40924

SEQ ID NO: 121920 - DNA, 201 bp, Bos taurus; identical to SEQ ID NO: 81229

SEQ ID NO: 121921 - DNA, 201 bp, Bos taurus; identical to SEQ ID NO: 40925

SEQ ID NO: 121922 - DNA, 201 bp, Bos taurus; identical to SEQ ID NO: 40926

SEQ ID NO: 121923 - DNA, 201 bp, Bos taurus; identical to SEQ ID NO: 40927

SEQ ID NO: 121924 - DNA, 201 bp, Bos taurus; identical to SEQ ID NO: 40928

SEQ ID NO: 121925 - DNA, 201 bp, Bos taurus; identical to SEQ ID NO: 40929

SEQ ID NO: 121926 - DNA, 201 bp, Bos taurus; identical to SEQ ID NO: 40930

SEQ ID NO: 121927 - DNA, 201 bp, Bos taurus; identical to SEQ ID NO: 40931

SEQ ID NO: 121928 - DNA, 201 bp, Bos taurus; identical to SEQ ID NO: 40932

SEQ ID NO: 121929 - DNA, 201 bp, Bos taurus; identical to SEQ ID NO: 40933

SEQ ID NO: 121930 - DNA, 201 bp, Bos taurus; identical to SEQ ID NO: 40934

SEQ ID NO: 121931 - DNA, 201 bp, Bos taurus; identical to SEQ ID NO: 40935

SEQ ID NO: 121932 - DNA, 201 bp, Bos taurus; identical to SEQ ID NO: 40936

SEQ ID NO: 121933 - DNA, 201 bp, Bos taurus; identical to SEQ ID NO: 40937

SEQ ID NO: 121934 - DNA, 201 bp, Bos taurus; identical to SEQ ID NO: 40938

SEQ ID NO: 121935 - DNA, 201 bp, Bos taurus; identical to SEQ ID NO: 40939

SEQ ID NO: 121936 - DNA, 201 bp, Bos taurus
caccactgggtctcttggggcttctgcctttgcaaactctgtcttcattcagctctcctccaggtgggcctccaccctctccatcaggtcctcctggccartgtgccaatgcatcactgcctattagagcccaggcaggactcttgtctttatcacaacaacctcaggggcacacccactatatggcagggggcgaggggc

SEQ ID NO: 121937 - DNA, 201 bp, Bos taurus
gagagtcagggaagtcagccacggtgataaaagtgtctgtagaagaggtggagggtgcatcacagcgaggggtggacaggagacaggccgtctcccacaayagttcattaccagcctgggctttgggatccaggcgtaaaggtgtcttggagggcagaaggaaggatggggcaggaaagcccctgaggccaggaaccatcc

SEQ ID NO: 121938 - DNA, 201 bp, Bos taurus; identical to SEQ ID NO: 40940

SEQ ID NO: 121939 - DNA, 201 bp, Bos taurus
gggtgtgtcttgtttggagctggttggttgaggcctggttggaagaagggagtcagcttgttaattcaacgagccatgcatctccctgctcctggcttcaytgtgcctggcctgtcccccccagagcagcagccaggtcatcctctcatgtccccctgctgccctccatgaagcctttgaggggttgtcctctgtccttga

SEQ ID NO: 121940 - DNA, 201 bp, Bos taurus
gggcttaaaaatctctgagggctttacaattaataagacaatgtggaaggccattacagcttgtaaaatagtatacaaaatgaacgtgttataattattayaattgtggaaagacctccaggccccctctagtccttagggtactcctcttgctggctagatgagctcctttccagctctcccttagaaccacccctttct

SEQ ID NO: 121941 - DNA, 201 bp, Bos taurus; identical to SEQ ID NO: 40947

SEQ ID NO: 121942 - DNA, 201 bp, Bos taurus; identical to SEQ ID NO: 40948

SEQ ID NO: 121943 - DNA, 201 bp, Bos taurus; identical to SEQ ID NO: 40949

SEQ ID NO: 121944 - DNA, 201 bp, Bos taurus
ctggcagaggccgctgagtggaaggcagcgtccaagcctgcatgccccagtggtagttctgagaactggaagcagtcctggatgaaagtccaggaatactygcagggcctttaaatatatatggtctaggggcattgtgagcagcaactcctgtgtgccctgaccctgcttcctcctgtggtcggagacacacagccaaga

SEQ ID NO: 121945 - DNA, 201 bp, Bos taurus
ctatttccactcctgcccaaatagtttaactcattgcaatgaaaagctctgtatgccatttcttttatagaacccatttctttgattcacttccaaatagkttaaagtttgagtataaaatagactgcagtctagatttgaactcctcaaatgtaagtactaacctctgtgttcctgccgatcattcacaatccaccaggt

SEQ ID NO: 121946 - DNA, 201 bp, Bos taurus
gtccaagcagacaaggagtcaggaggccaggaaagaagccgctggcaccagcctccatgactggtcagcaaaggtggcagaatgcagccagtgggcaaagyggaggccaagggaccgttctgtgcacacacctaggaccccagcctgttccagggatgagggggagggcacactcagagggacctggctatttgccgtcaa

SEQ ID NO: 121947 - DNA, 201 bp, Bos taurus; identical to SEQ ID NO: 81251

SEQ ID NO: 121948 - DNA, 201 bp, Bos taurus
tgagccggggagccaggccagagtgctcgcagcctcctcgcaggcaggcgggtgaaagatggccccattcctcacggggagacgtgctgggcgagggcccrgtgccctttgctgagcgcccgtttctcacacggggagcctcatttttcaatcacgcccgcgctcaggcttcatctggccacccccccacgtcactccctc

SEQ ID NO: 121949 - DNA, 201 bp, Bos taurus
tcttccaatgaatattcagggtggatctcctatcatctagagagtccattaatctaggagcccagtatacttgagaactagcccatggactccctagtgtrctgtgtcatgctaagtctcttcagtcttgtccaactttttgcaacactatggactgtagcccaccaggctcctctgtccatgggattctccaagtaagaa

SEQ ID NO: 121950 - DNA, 201 bp, Bos taurus
gggaatggaagacccacgaaggaaaggccgtttagttttgtgtcttcaaacctgaaacatttctaggtttgaccggagtcctgtcaaactgagcacaatcrggtgtgaggcccgctccttgggctttaacaaactgttatctgcaatctgctgcacaatctgaaaaggcaagaaatgcggctttccctgtttagaaaatct

SEQ ID NO: 121951 - DNA, 201 bp, Bos taurus; identical to SEQ ID NO: 81254

SEQ ID NO: 121952 - DNA, 201 bp, Bos taurus
gccggacttccaggctcagatgtggcacgcccctttgactcttgccgcagccctgtgaagctaagtcacgactcacttcctggcagatgtttcaagggccraagtgctagtgtcagtcaccatttgatcccccttctgggtggctaaaaagccagtttaggaggagacaggacggcccagggccctcgcagctgtctggct

SEQ ID NO: 121953 - DNA, 201 bp, Bos taurus; identical to SEQ ID NO: 81257

SEQ ID NO: 121954 - DNA, 201 bp, Bos taurus; identical to SEQ ID NO: 81258

SEQ ID NO: 121955 - DNA, 201 bp, Bos taurus; identical to SEQ ID NO: 81259

SEQ ID NO: 121956 - DNA, 201 bp, Bos taurus; identical to SEQ ID NO: 81260

SEQ ID NO: 121957 - DNA, 201 bp, Bos taurus
ctcttcattttccatgagaaaagcgaagccgggcaaaacctaacttcttcggaggagggcttcttttctgtgaaatacccactcagcgtgcagacttggtrgtggagactgtttgtggaagttcctagcactaataaaatttaatttaaaacagtgagcccgctgccttcctgtgacatgtatatgggacttacataatta

SEQ ID NO: 121958 - DNA, 201 bp, Bos taurus; identical to SEQ ID NO: 81261

SEQ ID NO: 121959 - DNA, 201 bp, Bos taurus; identical to SEQ ID NO: 81262

SEQ ID NO: 121960 - DNA, 201 bp, Bos taurus; identical to SEQ ID NO: 81263

SEQ ID NO: 121961 - DNA, 201 bp, Bos taurus
ggcagacgctgggaggacaatctgctctccttgggccgccgcttgaacattcgtatctcgcagaagcaccctcacagacgccctagaaggatgtatgaccraatgtctgggcaccagggccggtcagcttgacactggacagtgagcttcacaccttccaaccgacctggctctgagctgtgtgccctggggtccctctcc

SEQ ID NO: 121962 - DNA, 201 bp, Bos taurus; identical to SEQ ID NO: 81264

SEQ ID NO: 121963 - DNA, 201 bp, Bos taurus
agcaggaacaaaggccaggcagggcccacagcctgcggacacatggctgttctgagccgggatgtgtgtgccacagctgatgagatggagagactcagagyagagcagagagggcccaccccccgaggcaaagactgggcctcagttcagttcactcgctcagtcacgtctgactctttgcaacctcatggactgcagcac

SEQ ID NO: 121964 - DNA, 201 bp, Bos taurus
ggcccgatcaccctaaaacatgacaaaaacccaggagcttgtaattaatgggggggcagagaaggcagcagagagctgggcagtgacctgtgccgagggtrcatgtctgccaccccaggggccgggactcctggactgatgccaaagcacggagatgggagaacgcgttccgctgggggaggggaggtgcagctgaaggcg

SEQ ID NO: 121965 - DNA, 201 bp, Bos taurus
ggtgggtgggtgggatggcctttgctttgggaaggagtggaggccaagaccccaggatgctgctgtgcatggacgacagtgcggggctggcgggacgcccygctctgtcagggctatggccatttcgatgcctttggtcatctgtgggcacgtgccttagaagtgacaacacgctggttctgcctagaggtctgtgtttaa

SEQ ID NO: 121966 - DNA, 201 bp, Bos taurus; identical to SEQ ID NO: 81268

SEQ ID NO: 121967 - DNA, 201 bp, Bos taurus
agaggccagagtgagaccactgccctctccctagacggggccttaagacactcagctctttcactcagttcctctaaggaagcccctctctcgaagccacrtgcagtcagcctggtgcggggcctgggcccggctgggaacgcacgagcacagcctctggctggaaaaggccacttgggaggctggttctggagtggaggc

SEQ ID NO: 121968 - DNA, 201 bp, Bos taurus; identical to SEQ ID NO: 81269

SEQ ID NO: 121969 - DNA, 201 bp, Bos taurus
tgactcctgggacccccgtgagtgagggcaccctgcgtgtgcgccatgacggtcatttcactgagcatcgcgtcctcaaggcttgtgggcatcgtggcctrtgttgaaatcccttcctctttggggctgagtgatgttccgtgtgtgtggatgggcatctgcttctctgtccatccaaccacggccactgagtcgctgccg

SEQ ID NO: 121970 - DNA, 201 bp, Bos taurus
ggtggcggggtttcagctgcctgccgggaggcccttctgtccagtgacccgatctgctccttagccacatgcagcgacagtggtcacatgcagatgtggtyttcagacaagggcccaggccttccagctgaccaggtgcccatggtaaacagggctgaccgctttcatccaggccgatgactcttgatgcatcgttgtctg

SEQ ID NO: 121971 - DNA, 201 bp, Bos taurus; identical to SEQ ID NO: 81270

SEQ ID NO: 121972 - DNA, 201 bp, Bos taurus; identical to SEQ ID NO: 40952

SEQ ID NO: 121973 - DNA, 201 bp, Bos taurus; identical to SEQ ID NO: 40953

SEQ ID NO: 121974 - DNA, 201 bp, Bos taurus; identical to SEQ ID NO: 40954

SEQ ID NO: 121975 - DNA, 201 bp, Bos taurus; identical to SEQ ID NO: 40955

SEQ ID NO: 121976 - DNA, 201 bp, Bos taurus; identical to SEQ ID NO: 40956

SEQ ID NO: 121977 - DNA, 201 bp, Bos taurus
gtggccccagctcgcagctgtcctgcgggctgactggggtgtgcgccgcgtgctcagcatggggggacggataacctgggcagacagcgtgctgactgacrcgcacggagggccccctgggctgcggggaagctggactagggggccggtagaagatggtcaggcagacgtgcagccctgagcctccgagtgccttcggcc

SEQ ID NO: 121978 - DNA, 201 bp, Bos taurus; identical to SEQ ID NO: 40957

SEQ ID NO: 121979 - DNA, 201 bp, Bos taurus; identical to SEQ ID NO: 40958

SEQ ID NO: 121980 - DNA, 201 bp, Bos taurus; identical to SEQ ID NO: 40960

SEQ ID NO: 121981 - DNA, 201 bp, Bos taurus; identical to SEQ ID NO: 40963

SEQ ID NO: 121982 - DNA, 201 bp, Bos taurus
agccactggtgaggttgatgctggtgaggcagggccccattgaatagcgagtcttcagaccttgctgtgcctgggatgggcagggagtctggagggggacrggagacctgtgcacatggtcccatttatccaggtctggggaggagatcggaagggtaacagctcttccaaaggccaggcagttggcagtttaaagcggcc

SEQ ID NO: 121983 - DNA, 201 bp, Bos taurus; identical to SEQ ID NO: 81281

SEQ ID NO: 121984 - DNA, 201 bp, Bos taurus; identical to SEQ ID NO: 40965

SEQ ID NO: 121985 - DNA, 201 bp, Bos taurus; identical to SEQ ID NO: 81285

SEQ ID NO: 121986 - DNA, 201 bp, Bos taurus; identical to SEQ ID NO: 40969

SEQ ID NO: 121987 - DNA, 201 bp, Bos taurus; identical to SEQ ID NO: 40971

SEQ ID NO: 121988 - DNA, 201 bp, Bos taurus; identical to SEQ ID NO: 81288

SEQ ID NO: 121989 - DNA, 201 bp, Bos taurus; identical to SEQ ID NO: 81289

SEQ ID NO: 121990 - DNA, 201 bp, Bos taurus; identical to SEQ ID NO: 40973

SEQ ID NO: 121991 - DNA, 201 bp, Bos taurus; identical to SEQ ID NO: 40974

SEQ ID NO: 121992 - DNA, 201 bp, Bos taurus
aagtgactgaggccctccgtgtcaggaaaggcaaacctacatccaaaacacgctgcttctctgttgagatcaagctctacctttcccagggaggaaggagyccagtgtggccaactttcccccaagagatggctggctctgcaataaacagtgtcaagtgaaggctcggtgttggcctctattttaggcagtttgggtttt

SEQ ID NO: 121993 - DNA, 201 bp, Bos taurus; identical to SEQ ID NO: 81293

SEQ ID NO: 121994 - DNA, 201 bp, Bos taurus
gctggataaattttcatgtggagggaagaactggagagagcagcagaaagtaaaaattcagagatttaagaacatttaacatacttctcctgccccactgyacaaatccatctgtagaggctggaaaacttatcacctcaagaagactgaacacaattttttccccaaatcactggctgaccagtatgttattaagtctta

SEQ ID NO: 121995 - DNA, 201 bp, Bos taurus
tgtggtaatttgcttatcgcccatgaatggcacttaaacaaaagcaacaatgcacatttcattgaaaagcatttggtttaggcaggttggcaggtgcttcrgaaagccctcaggcttcattcccaaaacataaatctcaatcctgcagtgaggagcttcaggcaaaggcagggggagaagagctgtttccttaacgtgtgt

SEQ ID NO: 121996 - DNA, 201 bp, Bos taurus
ataaaatgcactctacagtgatcaaagctattatagtctactaaaatttatcttgaatataatagaaggaaagggccacatactaggtgaatgtctttatyttcaattttatagacgttcttgaatggattctgcctttgatcattcaataatggcctctcctgagaaccaagtatcttgaaagtgaaatttaagaacctt

SEQ ID NO: 121997 - DNA, 201 bp, Bos taurus; identical to SEQ ID NO: 81294

SEQ ID NO: 121998 - DNA, 201 bp, Bos taurus; identical to SEQ ID NO: 40977

SEQ ID NO: 121999 - DNA, 201 bp, Bos taurus
ttaattaaaaaacatttattcggcttaagttgcattagtatttcaggccacgtaaacttgtagctaatcttcaatccgcttgggttttaggtgtgaaaagyggaccaacaaggcacagtgttgtggccagctcacggaaaggctgccaggacctcctcagactgcgggaggaatccgggaagaagggcagaggccaggagg

SEQ ID NO: 122000 - DNA, 201 bp, Bos taurus
tgttctgctcttgtttttacccagagggacggaagcgggttatgagccaggccgggcagagcgggaggcaggttccccgggcccctgggttgcgccccgcycctctctggggctccacaggcacagagcagcgcgactcggttccttcggagactcggccttgtggcctgtctagagccctggaagatttcctgtgtggcc

SEQ ID NO: 122001 - DNA, 201 bp, Bos taurus; identical to SEQ ID NO: 81302

SEQ ID NO: 122002 - DNA, 201 bp, Bos taurus; identical to SEQ ID NO: 40982

SEQ ID NO: 122003 - DNA, 201 bp, Bos taurus; identical to SEQ ID NO: 40983

SEQ ID NO: 122004 - DNA, 201 bp, Bos taurus; identical to SEQ ID NO: 81303

SEQ ID NO: 122005 - DNA, 201 bp, Bos taurus; identical to SEQ ID NO: 40989

SEQ ID NO: 122006 - DNA, 201 bp, Bos taurus; identical to SEQ ID NO: 40990

SEQ ID NO: 122007 - DNA, 201 bp, Bos taurus; identical to SEQ ID NO: 40991

SEQ ID NO: 122008 - DNA, 201 bp, Bos taurus; identical to SEQ ID NO: 40992

SEQ ID NO: 122009 - DNA, 201 bp, Bos taurus; identical to SEQ ID NO: 40993

SEQ ID NO: 122010 - DNA, 201 bp, Bos taurus; identical to SEQ ID NO: 81315

SEQ ID NO: 122011 - DNA, 201 bp, Bos taurus
tagaaatccctataatgctcttaacatactaataatgtcatcccacagatagatagtaaaatattcccaatcaataacaaaggcgaaaacttgacacatgygatctgataattatgggagaacgtgtatctgcacacctagccaatttccagtgtctaacttagcactaaaagaagacaaatttggaagtttccaaactgg

SEQ ID NO: 122012 - DNA, 201 bp, Bos taurus
taagaaataatctgtagtggaggattttttggtcattatttctattttaattttgtccttccaattcttgtttaggggaaacttttaaattccctgctgtrtagagtttcttttctttacttttcctacttaaaaaaatcatctttatatcatgatcaaagaaaatggtacttataacacaatacttgtaattttgatctt

SEQ ID NO: 122013 - DNA, 201 bp, Bos taurus; identical to SEQ ID NO: 41001

SEQ ID NO: 122014 - DNA, 201 bp, Bos taurus; identical to SEQ ID NO: 41002

SEQ ID NO: 122015 - DNA, 201 bp, Bos taurus; identical to SEQ ID NO: 81320

SEQ ID NO: 122016 - DNA, 201 bp, Bos taurus; identical to SEQ ID NO: 41007

SEQ ID NO: 122017 - DNA, 201 bp, Bos taurus; identical to SEQ ID NO: 41008

SEQ ID NO: 122018 - DNA, 201 bp, Bos taurus
gaagttatgagaaccaaatttcataaacatttttctattgatacttcctcaatgtctggtgattcttggttcccgttatacctgaattaggcagtattaamaagttctgatctttataggcgataaaaatcttgttattaaacagactttgaaagagctaaatgttattttctagaaatgcaaaaaatatcaaaatgaggc

SEQ ID NO: 122019 - DNA, 201 bp, Bos taurus; identical to SEQ ID NO: 81327

SEQ ID NO: 122020 - DNA, 201 bp, Bos taurus; identical to SEQ ID NO: 81328

SEQ ID NO: 122021 - DNA, 201 bp, Bos taurus; identical to SEQ ID NO: 41012

SEQ ID NO: 122022 - DNA, 201 bp, Bos taurus
ttttaaatttattatagtaagcattatttatggacaagagcaggttatagcacttcatagtgtgtagtgggagcatttttaatagtagaaatggttttgcytgggcaactttacattcttggtgtgtaattttaatctccataaaaatatgtcactgttgtgtaataccaaatgtaggattccagttgaaagcaactttca

SEQ ID NO: 122023 - DNA, 201 bp, Bos taurus
cataaaacaggaaagacaaatgttgccagaaaaaaaaaaaaatctataacaaatgtggagtaaactctgtgaatgaaaatctgctgtatgctggtgtgatygttaaatagaaacccagggtatttgtgtatttgttttgttaatgagcaaatcctgcccatgtacataaaggcaagtttattcccaaagatatggtacaga

SEQ ID NO: 122024 - DNA, 201 bp, Bos taurus
tatcattataatatacataatatataatatacatacatttatttatgaatgagttggtgatgttattctagaataaatgtccactgttaatgagttggttrtctgacttagatggcccctacttttgtttctttctgccaaaattaataagttcccaaaatttggggtttaaaagttaaataagaggtttatgcaaatatt

SEQ ID NO: 122025 - DNA, 201 bp, Bos taurus
agtgggagggtgtggctggtatatttcttccccaggccctcccaggtgggctaggcggtggccctgtccctctgctaaggccaccatgccctctagatgayctgttctttactgcggtcacttcttacttcctctaggtgtcaacttagacaccagttttcaggcccagggatggttcctcttagcctagctcataacttg

SEQ ID NO: 122026 - DNA, 201 bp, Bos taurus; identical to SEQ ID NO: 41086

SEQ ID NO: 122027 - DNA, 201 bp, Bos taurus
actgcttccattataaccctctgtttgtacctcctcataattttctgacaaattgtccctctcagatgaagtctttcatgcttagtcttatcctagtggtrcattttctttccttgcctttataaagaaaaatgtaacctttttttttttttttaatccaagttcaaacaagtaccaagcagccattccttttagtgaatt

SEQ ID NO: 122028 - DNA, 201 bp, Bos taurus; identical to SEQ ID NO: 41087

SEQ ID NO: 122029 - DNA, 201 bp, Bos taurus; identical to SEQ ID NO: 41088

SEQ ID NO: 122030 - DNA, 201 bp, Bos taurus; identical to SEQ ID NO: 41089

SEQ ID NO: 122031 - DNA, 201 bp, Bos taurus
aaattatagaatgggtaatatgtttaatgagtttatttagttgtaaacgaagctgtaaaaataatttgttaaactctcctccctttggccttggcaggcasttaacattttgcttaaacagtaaaagaagtctattgaagagcaaaggaaacctcaagttgcttaaggccagcagcactctttgggcccatgtttctccac

SEQ ID NO: 122032 - DNA, 201 bp, Bos taurus
taaatgaatccaacatagtaaacctctatagtcatgtaaaacatcaaacacaagggtatttaatatttcgtatgataatcttctgtcccatgggttagtaygaatcatattttattctggatatggaggatgttttgcagaaagttttaccagctttcaattcagttcagttcagtcactcagtcatgtccgactctttgc

SEQ ID NO: 122033 - DNA, 201 bp, Bos taurus
tgttctccactatggtgtattaaataaagcagctcataaagtgtaaataaaatgcgtaagtgcattaacagtcttctcaaatgctttttaaaggtaaaacyttttgtaatcagtattaactaatttctgtaagagcctgatgcagtatgaattcatttgatgttaatataggtgccattttcttctggagggcagtgataa

SEQ ID NO: 122034 - DNA, 201 bp, Bos taurus
atttgaaagttcgaactgtctttagtgtcaacctcttcaatttccagcagatggcgccataacaacacgccaggaaacgtgaacggcctaacaggatgccmagcttgtttaaggtcaggagtaaaaggctgtttgcttactaaatgaaaaatcaatttgagaaatgccattctgtcacgatataaggatgattttggccaa

SEQ ID NO: 122035 - DNA, 201 bp, Bos taurus
ctgtttgatggttagtgtccggtcggtactgttcagagttcgtttccttgcccttgaggttgtggatccattttctgctcaatttctttacattagctttkaagtccgaaagctcagattggttgtctccatattccgagcgggaaggcagcgatccactctcagacttgctcccagaggcataagaccagggctgcagta

SEQ ID NO: 122036 - DNA, 201 bp, Bos taurus; identical to SEQ ID NO: 41091

SEQ ID NO: 122037 - DNA, 201 bp, Bos taurus; identical to SEQ ID NO: 41094

SEQ ID NO: 122038 - DNA, 201 bp, Bos taurus
tgaaagcataccagattctctcccaggttttacatttagatttaattcaaatatagtcacagtgccacatatttagattctagagctgagaacaacatttytgaagttccccctttcggtcacagtccctgtattatatttattatttttgtgaagggacagacagtctgacctttcttccctcagcctgcctagattaag

SEQ ID NO: 122039 - DNA, 201 bp, Bos taurus
ctcctcaggcacctttgtaggcaatgatgattccttctgcagcctgccctctcccaaggaactgtccagcttcagcttcagcatgaagggccacgagaagrctgccaagtccaagacgcacagcctgctgaagcgcatggagagcttaaagctcaagggctcccaccacagcaagcacaaggcgccttccaagctgggtct

SEQ ID NO: 122040 - DNA, 201 bp, Bos taurus
gacagattctgtaacatgaacattattatgctcgttccacagtcaaggaatctaaggcgcccactgcctgttctctgtgctaacaaacgggtaaagaagakaaagagaaacaagtgagcaaataggctgttgtcattataattcatcataacaccactcacagggttcccgcaacaccaagtgtattcaggcctcatcgga

SEQ ID NO: 122041 - DNA, 201 bp, Bos taurus; identical to SEQ ID NO: 41099

SEQ ID NO: 122042 - DNA, 201 bp, Bos taurus
cccactctaaccagatttgctatgaacccaaccaaaataatacggcttatttctcccatcatgtgacagttcggctggctccctgccacacattcaacacrtaccctaagtgaaacagtatccatattctattgtggttccaggtaagaaaggaagtacaaggttgccaagagtcagagaagtaccacctcgttagaccca

SEQ ID NO: 122043 - DNA, 201 bp, Bos taurus
ttgactaaccatggatgtttgtctttctctggttggtcccaggttagaagacagatggagaagctgtcagttgtcactcaagttctggccatttggggttkattattatggaagttactgtttggtttcctggattgttgttagagatagcagtctgaccttctgtgcctcccacttcctgggcctgttatggtagataag

SEQ ID NO: 122044 - DNA, 201 bp, Bos taurus
ttgtatttgtttagaaagtggtacagaaaatgtaaactcagacctaaaagccatttgaagttacagctgaagactacaaaccatcactatttctctggccraggtccctcaccctcacacttagggtggagaagataactgctcaccaggatcagcccagtacagacgagtccctgcatctgaaaagctcaggcccacagg

SEQ ID NO: 122045 - DNA, 201 bp, Bos taurus
ctaataaatactgtgacttgtgaatgctgagtgctgacagaagttggaaaatgtgcaattaataataataaaatgatatggtaaattgcgatgacgcatartgctttaaaaattgatactaaaatgatttatttggtggtgtgtgtgtgcatgctccgttatgtctaactctgtgaccccatggtctatagcctaccaggc

SEQ ID NO: 122046 - DNA, 201 bp, Bos taurus
gctgtctcacgatcaagaccccactgaggactattttggcgtttctgcagctgctggcagagcccagatgggtgtaaccacgttgggagagttagtgatartgtaaacagccgactcccgcaaggtaggagggcggaccaggggcgaggcgttttctaaaatcgctaatgttctgtaagaacaaatacacgcggctgagta

SEQ ID NO: 122047 - DNA, 201 bp, Bos taurus
ggatgcaagtgagctgtgttcaccctgcagggcttcctggaagaccaaattgctcaagaattcctcataccctcccgcccgccccggaggaggaaaattcragatcacctaggccaacccttctgttcacagagatgcaaacaggcccaagtaaagcaacctctcaattggccagccatgtaaaagggaaaagccaggtgt

SEQ ID NO: 122048 - DNA, 201 bp, Bos taurus; identical to SEQ ID NO: 41110

SEQ ID NO: 122049 - DNA, 201 bp, Bos taurus; identical to SEQ ID NO: 41111

SEQ ID NO: 122050 - DNA, 201 bp, Bos taurus; identical to SEQ ID NO: 41114

SEQ ID NO: 122051 - DNA, 201 bp, Bos taurus
tagagtggggtgtgaagctcagtgatgctcttccaaacccgaagagtcaacacgaccaaccttcgctaatgaagtcatcgtgagacctacccaagtgagayagaaggactgggaaatctcagatgaccttgttagataaagtcctttagcattttatagtgccagggcccaaagagaacaaccagagagaggtaaactgtg

SEQ ID NO: 122052 - DNA, 201 bp, Bos taurus; identical to SEQ ID NO: 41115

SEQ ID NO: 122053 - DNA, 201 bp, Bos taurus; identical to SEQ ID NO: 41116

SEQ ID NO: 122054 - DNA, 201 bp, Bos taurus; identical to SEQ ID NO: 41118

SEQ ID NO: 122055 - DNA, 201 bp, Bos taurus; identical to SEQ ID NO: 41119

SEQ ID NO: 122056 - DNA, 201 bp, Bos taurus; identical to SEQ ID NO: 41120

SEQ ID NO: 122057 - DNA, 201 bp, Bos taurus; identical to SEQ ID NO: 41121

SEQ ID NO: 122058 - DNA, 201 bp, Bos taurus; identical to SEQ ID NO: 41122

SEQ ID NO: 122059 - DNA, 201 bp, Bos taurus
aacccactgatcttattcaaatttccctagctttattgatacttatttgtttgcatgcctgtgtgtttattaagttctatacaattttatcatctgaacargctcatatatctgctaccagagtcaaaatactgaatattccaacaccacaaggatgctcctttaaaccacatccacctccttcctgccctaccccacccc

SEQ ID NO: 122060 - DNA, 201 bp, Bos taurus; identical to SEQ ID NO: 41124

SEQ ID NO: 122061 - DNA, 201 bp, Bos taurus; identical to SEQ ID NO: 41125

SEQ ID NO: 122062 - DNA, 201 bp, Bos taurus; identical to SEQ ID NO: 41128

SEQ ID NO: 122063 - DNA, 201 bp, Bos taurus; identical to SEQ ID NO: 41129

SEQ ID NO: 122064 - DNA, 201 bp, Bos taurus
cttgtcccttgtggacagtctgcggctccaggtgaatcaaggtaaaggagcgagcagggattatgagtcacccaccaggaaggcctttaagtaaaagctcrggattaagacctcacagtggactggcagcgcccaccgagggagcaacagagttgagcaacaataacaatgactccgggagtgagtaagcgctactcacag

SEQ ID NO: 122065 - DNA, 201 bp, Bos taurus; identical to SEQ ID NO: 41130

SEQ ID NO: 122066 - DNA, 201 bp, Bos taurus
atcaatagttatattaactgtaaatggtctaaaaactccatttaaagaaattgttagaattggtttaaaaatatgacccaaccatatgcagtccacaatayattcactacagatataattatataagttaattaaaaataaaaggatacagacattgtaaagcagttaaattccaagtaaaaaataaataagaattgaaaa

SEQ ID NO: 122067 - DNA, 201 bp, Bos taurus
gataaagagcagtaacaggtgtgaactgagttgctcatggaagtggaagcaaaactactctggtacgctgcaggctttcttccttgagagagggagagtgygagccatgttcccagttcactgtgaatgtggttgttccagcacagtaaaggcagcgtgtgtgagttactggccgtggtgaaaagggaaggcttatccatt

SEQ ID NO: 122068 - DNA, 201 bp, Bos taurus
cctgatgggaagttatcagtgcttctaccaagtctgtctgctcctgttcccacaacatttcctgccagaatcaagccagaatgattccagaatccattgtrtaagactaaagaagagtgtctttctgctcacatttgacagctggtgtcggctttgatgactgaatcagcaaaacagacagaactcacacttttgtcaact

SEQ ID NO: 122069 - DNA, 201 bp, Bos taurus; identical to SEQ ID NO: 41131

SEQ ID NO: 122070 - DNA, 201 bp, Bos taurus; identical to SEQ ID NO: 41132

SEQ ID NO: 122071 - DNA, 201 bp, Bos taurus; identical to SEQ ID NO: 41133

SEQ ID NO: 122072 - DNA, 201 bp, Bos taurus
attccaacatatagcttccggctaatcacctcgcatcacccccaagaagacactttatagctgagacactggacgcggagaagcttgcttgcaaaaggccrtctagctggtgtttgagcatgaattcagacccacaatctcatcactgtgctgtctccaattacacttcacccattcaattctagcaactcttacttggct

SEQ ID NO: 122073 - DNA, 201 bp, Bos taurus
ggtttgaaagtctttgtgtagttcctttcttggccacagagacctggtcaggccaccttgcctctcactcagatcatccttcagaactagatatggtgctratgtttccaatgggaagcataccacttgacagtttattactatgatgcacatatcttcaggttcttgtgtttatgcagttgtgagaaatcagagcctgat

SEQ ID NO: 122074 - DNA, 201 bp, Bos taurus; identical to SEQ ID NO: 41136

SEQ ID NO: 122075 - DNA, 201 bp, Bos taurus; identical to SEQ ID NO: 41139

SEQ ID NO: 122076 - DNA, 201 bp, Bos taurus
gatgtaagtaacagtatttttcatatgggtgtatcattatataaggttcataagaatccttcaagctaatctcagagttgcttcagagtcagttactaatkgtcaaacatgccatccggacccaccagctttgctttgacactagaatgaagatatttaccccagtatccactttacgtgaccgcctctacatcggtcata

SEQ ID NO: 122077 - DNA, 201 bp, Bos taurus; identical to SEQ ID NO: 41140

SEQ ID NO: 122078 - DNA, 201 bp, Bos taurus; identical to SEQ ID NO: 41141

SEQ ID NO: 122079 - DNA, 201 bp, Bos taurus; identical to SEQ ID NO: 41143

SEQ ID NO: 122080 - DNA, 201 bp, Bos taurus; identical to SEQ ID NO: 41144

SEQ ID NO: 122081 - DNA, 201 bp, Bos taurus
tgtatactcctgtgccttttgatgagaaacattaaacatttttaatttagtacatcaatttgaaaatctaatttttttttaatgctttgtagtggcagacrtgttcacggtgctgtcacgaccatcgaagaattatgagaaacttgaaccgcaaaaagtaaattagaaaaatctcatttcagttactctaaaaagagggga

SEQ ID NO: 122082 - DNA, 201 bp, Bos taurus; identical to SEQ ID NO: 41146

SEQ ID NO: 122083 - DNA, 201 bp, Bos taurus; identical to SEQ ID NO: 41147

SEQ ID NO: 122084 - DNA, 201 bp, Bos taurus
cctgttcatttccaccaaaccactctgtcttctgcttagcccatgtaaactgaaggtgtttccatccttccagtggccgacatcaaagtctttgagttctktgctgtctttcttttgctacacatatctgggctgccaaaatttccattgactctactttcaaaataggttgagaatttcaaatcccccattagtctcatc

SEQ ID NO: 122085 - DNA, 201 bp, Bos taurus; identical to SEQ ID NO: 41150

SEQ ID NO: 122086 - DNA, 201 bp, Bos taurus
gagagcagttgacctgtcagattacgaaacaaataacagagctaccagccaggcccattatcttagcgctgcaccacacctgcgcacggcagacacctccrgagtggtccatcattcaaaagggccgtattttacccaatgaggtgcttactacgaactgctatagaaatgatctactaactccagcttcgttggcagtcc

SEQ ID NO: 122087 - DNA, 201 bp, Bos taurus; identical to SEQ ID NO: 41151

SEQ ID NO: 122088 - DNA, 201 bp, Bos taurus
ttttaattttctgaattaagagcctttaaaaaatatctcttttgtgtattacatcctctaatcatcactagctcccatacaaaaggtatgctttctctctygtacaggaaattggactcagagtgcttaagtaatttgctccaagtcagagccagaatttgattttggaattgttcacttcccgcttcctatgtttttatt

SEQ ID NO: 122089 - DNA, 201 bp, Bos taurus
ctcagtacactttccactcccccttgatgtattaataatcttttatttttaagcacatagacatcattagaaataaatttcagagccaggctggctgaaaragggccatttcaaggaacagctgtgactgtaggatggtttaaaacagaaattctgagctgaagaggggaagctttgtttcccgccttttgtattatggat

SEQ ID NO: 122090 - DNA, 201 bp, Bos taurus
gctatagaacatattctgagccatgtcctgtgagctgtcttgtagatactgaaacccctcaccaggtggaagaagttaactatatgatggccagattgtamccatgcatgagtccatttttttttcctttaataagcacaggtgtgtgtacaggaggtaagaactggctaagaatgtatagctttcacagtgggccttagg

SEQ ID NO: 122091 - DNA, 201 bp, Bos taurus
gaagtcgtgtctgactctttgcgaccccaagaactgtagcatgccaggcttgcagcacacccacattttgccaacagattaagaatgtaggaagaaggagraaggaaatgagggaaggagagggaaagagaatatgaatgagaacgagttctgagcaaccagaaggatagagttgccatgaaatggggaagattgggaaaa

SEQ ID NO: 122092 - DNA, 201 bp, Bos taurus
atctaaagttataaattcatcccatggtggcaaacacaccaaaatacattgtctctgcaggaagagtgaagttagtatgccctcggtcttctaaatacacycattacataagtgagtcctcttctttgaggaagacggtgataaaaagctcttgtcatattttctcttgtggagagtagagtagaaatctctttcatctgc

SEQ ID NO: 122093 - DNA, 201 bp, Bos taurus
tgactaagtgttgtccttgtgccaatgaacagtattttctccttctagatttctactggagtgtgatgtgatgtaaaaaaaaaaaaaaacatagcagcttkattcataaggcacaccaatccttatgtagagacaccagaaaatgtcacactgtgctggcttcacagtctgcatcatattagctaagctagtggtcataaa

SEQ ID NO: 122094 - DNA, 201 bp, Bos taurus; identical to SEQ ID NO: 41154

SEQ ID NO: 122095 - DNA, 201 bp, Bos taurus
tgcatcctgggatgaacacatctccttcagttgtcttttctgtcttcaataagtatatccctgtgcttctgttggaacttttccttctgaactttgctccygatagtgtcgctagttaacttccatatggtacatctgttatgtgccagaagcatctagaagctaggagacagagggaagcaggctgtggctggattctca

SEQ ID NO: 122096 - DNA, 201 bp, Bos taurus; identical to SEQ ID NO: 41158

SEQ ID NO: 122097 - DNA, 201 bp, Bos taurus
acctcctccccagtcggctctgccgtgggccaccagtcgtctttcttgtcaacctggagatccctgaaccgtgaaccttggcggcctcatctggccgggcrcagcctagaagccacatcacggtactgcgcatgcccagctcagtcccactgcgcctgcgcagcctgcacctggccagtcatctgggctgagtgcttttca

SEQ ID NO: 122098 - DNA, 201 bp, Bos taurus
ctgtaggatttcatatcaccttctagaaatccacacctgcttagtactgagtagccagcattttatctcccagaattacctttcttcagaggccaggtagytcttatgttcccagtgctcttgtttccagccttatgttttagaacctctaaagatgccttcctcatttcaattgatattcaattgatacataggaatcac

SEQ ID NO: 122099 - DNA, 201 bp, Bos taurus; identical to SEQ ID NO: 41159

SEQ ID NO: 122100 - DNA, 201 bp, Bos taurus
aactggtcttcaggcctggcttcgccagaagcgtttgcctcgtacttgatagggactttgggagcaaaaagctgccctttctgctcatacatcagaaagcrgtgcttgcattctggccacccctgaagacccttgtgctcaatctaaccatcccagcatgtgggtgaagagaccaggagccctggtcagtgtcttgactca

SEQ ID NO: 122101 - DNA, 201 bp, Bos taurus
cctgtgccaccgctggccatcttacagcacccttagccaagagcatcatttgtgcctgagatcccaaggatctgtgggtccacaggggagcactggaatcyacccaggtgacaactccggcctgcacaaacccaaataccgactccgtttccatgggcactttggccggacggtactttgttcaccattgcatttgggaga

SEQ ID NO: 122102 - DNA, 201 bp, Bos taurus; identical to SEQ ID NO: 41164

SEQ ID NO: 122103 - DNA, 201 bp, Bos taurus; identical to SEQ ID NO: 41166

SEQ ID NO: 122104 - DNA, 201 bp, Bos taurus; identical to SEQ ID NO: 41167

SEQ ID NO: 122105 - DNA, 201 bp, Bos taurus
gaaaatatacaattcttgtattcggtgcatacctggagtgtaaagtcccagatgacactggttaccgaacaagccacagctcatggtgctgcttgaagccygtttctttgtggatgaaaacaggagggagaatgcccttaccctcccccccaaccccacccccttctctccaagtctcttttcagggttcttacctcccct

SEQ ID NO: 122106 - DNA, 201 bp, Bos taurus
acctggagaacaaggggcagcactgtcttagaatcaggagtggcggcccgccgaggtggctttggaaccagctgcccgctgggctggctctggccacaggktctaccctgcccggcaccgccttctctccatgtgtctcatttctgaccagctttccatctctttcttgtctccatcacacatgcagtcagatgggccgaa

SEQ ID NO: 122107 - DNA, 201 bp, Bos taurus
cacctcccctcttctctcccgggggcaggccatcctggcctcccgcactccagggcagacaggactgtgccgagctgcccacagctctggcaggagtgccrgagacagctcagctaagtggcctgaactaatgacttcaagacctgcggggctggcccggagagagagctgggcttcggcttgcagggaaaaaaaaaaaaa

SEQ ID NO: 122108 - DNA, 201 bp, Bos taurus
ttagaaaggcatttgtcacggtaagaggacagagcataccttatgttagagtttccgtggtgtgtgggggcctccatttgtagtctcttcctgggcctctkgaatgttagacgtgagcctgtgggcaaggaggcagtaacacagtcaaaggtcctgaaacagcaaagcgtttggtgtattggtgcggcccagcctcggtag

SEQ ID NO: 122109 - DNA, 201 bp, Bos taurus
cctccgctaagggtgctcgtccttgtgggctggtgttgggaacatccatcttcagagaggctaacacagaggaagcttctgcagttgatgtcgcagcagcrgggccagttctcaggccaactagaaaaagatggatgctggcctttgactccacccacctccctgctttgtttgcgggtcctcctcttccacacagccagc

SEQ ID NO: 122110 - DNA, 201 bp, Bos taurus
agacctacctgctagtgttggagggtcttcctgtggaggtgtgggtcaacagtggcttccgcagggatgatggcactggcagcagtcctggaaaactcctyttggcgtaagtccttttggaggttgccattaaccccacacagagttcatagaccccagggctgggttgccacaagccaggcaactaacagagagggagca

SEQ ID NO: 122111 - DNA, 201 bp, Bos taurus
aaaaaaaagaaaactcaataaatttaggctctgatatagtaatttctcttaaggttaaaccttgtcaagaagaacagagtattctggtatgtttcaaaacktcttccattcccctccccctgctgaaaatgcaagggaatttttctctgttatttactgtgagaatctggtctagctcctagaggtaaaattcacaaaagc

SEQ ID NO: 122112 - DNA, 201 bp, Bos taurus
gtgctctgtcagttaatttctcccctccccacctgcaaccatggatcttctatttttttcccccagaatgtcatatagttggaatcatacagtatatagtstctgcaggttggcttctttaatttagtagtatgcacttaaatttcttccttgtcttttcatgaccttgcagctcatttctttttagggctgaataatatt

SEQ ID NO: 122113 - DNA, 201 bp, Bos taurus
tgattatcacaagacttataaaaacattttatagtgataacaggctatttaagataacagcttcaatttcatataaaattctacgcttttacttctttccycccacatctcatgctattaatgctgttataacattttttgatagagtgcatccttgaacaaattgttgcagttctagttatttttaatgcttttattttt

SEQ ID NO: 122114 - DNA, 201 bp, Bos taurus; identical to SEQ ID NO: 41175

SEQ ID NO: 122115 - DNA, 201 bp, Bos taurus; identical to SEQ ID NO: 41176

SEQ ID NO: 122116 - DNA, 201 bp, Bos taurus; identical to SEQ ID NO: 41178

SEQ ID NO: 122117 - DNA, 201 bp, Bos taurus; identical to SEQ ID NO: 41179

SEQ ID NO: 122118 - DNA, 201 bp, Bos taurus; identical to SEQ ID NO: 41182

SEQ ID NO: 122119 - DNA, 201 bp, Bos taurus; identical to SEQ ID NO: 41183

SEQ ID NO: 122120 - DNA, 201 bp, Bos taurus
tggccccatctcatagggcaacacccctgtgcttaaaaatgagaagactacggtcagagaactggccttgcatttgaggataggggccactgctgggttcrgggcatggggagaggagcgaaggggattttgcccatcttgagcttctgtggactgttttacaattgaagggggggatttgccatttcatgcggccctcag

SEQ ID NO: 122121 - DNA, 201 bp, Bos taurus; identical to SEQ ID NO: 81474

SEQ ID NO: 122122 - DNA, 201 bp, Bos taurus; identical to SEQ ID NO: 81475

SEQ ID NO: 122123 - DNA, 201 bp, Bos taurus; identical to SEQ ID NO: 81476

SEQ ID NO: 122124 - DNA, 201 bp, Bos taurus
tggccttttgtgaatttctattgattaagaagaccaggaaccctggtgagtaacagagtgacttagattaaataaggttcttcaggcagagaccggtgccygggagcaggccagacctctacccaacttgaggaagagcctgttgacaacctgcagaaaagtcagctgttttctcagcagagatttccaggctcaggtggg

SEQ ID NO: 122125 - DNA, 201 bp, Bos taurus
agtctacaaacagtaagccaagtataatgacacttacaccttgtcatgtgggttaaattttttgagattgtaaataggccttttaaaacccactagaacartcatgctttttttttttctataatgtgctatttattgatttacaatgaagataaaggcttcagtgttattcctctccattgcttaatcagggaacaaatg

SEQ ID NO: 122126 - DNA, 201 bp, Bos taurus; identical to SEQ ID NO: 41185

SEQ ID NO: 122127 - DNA, 201 bp, Bos taurus; identical to SEQ ID NO: 81479

SEQ ID NO: 122128 - DNA, 201 bp, Bos taurus; identical to SEQ ID NO: 41187

SEQ ID NO: 122129 - DNA, 201 bp, Bos taurus; identical to SEQ ID NO: 41192

SEQ ID NO: 122130 - DNA, 201 bp, Bos taurus
caaacctaaggctcacttgttcctattctgtgccctgaagtgttgggctgcttggccaagtcccaggagctatattagggaaatactttcccttcagccayggttgaaaatggaactatgtgtataaatagacatcttgcttcttacatatttatttgccaattttactccgagtataatgcaagttcaataaaaatgtga

SEQ ID NO: 122131 - DNA, 201 bp, Bos taurus; identical to SEQ ID NO: 41194

SEQ ID NO: 122132 - DNA, 201 bp, Bos taurus
tcccctctgccccggcccccagcagcagcctccatctgcaaagcctggcaccttctattccggagcccccacagcagaactcctgcctcttcgtcaccccmaaaaggcagaggccccagtgcccgtctgtggctgggaaagctggggcagagggaggctgccaagagacgcatgtccagaggcatgagcgggaggaggagg

SEQ ID NO: 122133 - DNA, 201 bp, Bos taurus; identical to SEQ ID NO: 41196

SEQ ID NO: 122134 - DNA, 201 bp, Bos taurus; identical to SEQ ID NO: 81489

SEQ ID NO: 122135 - DNA, 201 bp, Bos taurus; identical to SEQ ID NO: 41197

SEQ ID NO: 122136 - DNA, 201 bp, Bos taurus; identical to SEQ ID NO: 81492

SEQ ID NO: 122137 - DNA, 201 bp, Bos taurus; identical to SEQ ID NO: 81495

SEQ ID NO: 122138 - DNA, 201 bp, Bos taurus
actgctgccagcatgagtgccagtcattagtacagcagagctgggtggttaagagagagtattggggtaggttatatcattttagcaccccagatttagcmgtactgtcctttaggccaacttgaagtttcagccgcatcacctgcattgtcagactgtgaaatcttgcccggcaatgagatccaattccagtactgaatg

SEQ ID NO: 122139 - DNA, 201 bp, Bos taurus; identical to SEQ ID NO: 81496

SEQ ID NO: 122140 - DNA, 201 bp, Bos taurus; identical to SEQ ID NO: 81497

SEQ ID NO: 122141 - DNA, 201 bp, Bos taurus; identical to SEQ ID NO: 81499

SEQ ID NO: 122142 - DNA, 201 bp, Bos taurus; identical to SEQ ID NO: 81500

SEQ ID NO: 122143 - DNA, 201 bp, Bos taurus; identical to SEQ ID NO: 81501

SEQ ID NO: 122144 - DNA, 201 bp, Bos taurus; identical to SEQ ID NO: 41199

SEQ ID NO: 122145 - DNA, 201 bp, Bos taurus
ctttcgtgcactgtcaaggagagcaggtcacttgaattccgtctaagagttctgaattcagtacgtgaaacccattgcatctataaataccaccaccccgmtgataggtacacttcagttttgtgatcgcttctactctagccagtattgctttatgtcctgttgacgaatcctgcagaaacaatcagaacgtcagcctca

SEQ ID NO: 122146 - DNA, 201 bp, Bos taurus; identical to SEQ ID NO: 81503

SEQ ID NO: 122147 - DNA, 201 bp, Bos taurus
aaatgcatcagagacataaacagagaacaggaatgaagttagaacacacatcacagcgtgaacttgtgacccgcaatgtggccggcagcccatgggaagcrgtcagccaggtcagctccacaattcagaatgtccaccggaagggaagcaggccaaccgctcgggaagaattgtgtaacttacagcgtttccttttcccca

SEQ ID NO: 122148 - DNA, 201 bp, Bos taurus; identical to SEQ ID NO: 41201

SEQ ID NO: 122149 - DNA, 201 bp, Bos taurus; identical to SEQ ID NO: 41204

SEQ ID NO: 122150 - DNA, 201 bp, Bos taurus; identical to SEQ ID NO: 41205

SEQ ID NO: 122151 - DNA, 201 bp, Bos taurus; identical to SEQ ID NO: 41206

SEQ ID NO: 122152 - DNA, 201 bp, Bos taurus; identical to SEQ ID NO: 41207

SEQ ID NO: 122153 - DNA, 201 bp, Bos taurus; identical to SEQ ID NO: 41208

SEQ ID NO: 122154 - DNA, 201 bp, Bos taurus; identical to SEQ ID NO: 41209

SEQ ID NO: 122155 - DNA, 201 bp, Bos taurus; identical to SEQ ID NO: 41210

SEQ ID NO: 122156 - DNA, 201 bp, Bos taurus; identical to SEQ ID NO: 41211

SEQ ID NO: 122157 - DNA, 201 bp, Bos taurus; identical to SEQ ID NO: 41212

SEQ ID NO: 122158 - DNA, 201 bp, Bos taurus; identical to SEQ ID NO: 41213

SEQ ID NO: 122159 - DNA, 201 bp, Bos taurus; identical to SEQ ID NO: 41214

SEQ ID NO: 122160 - DNA, 201 bp, Bos taurus; identical to SEQ ID NO: 41215

SEQ ID NO: 122161 - DNA, 201 bp, Bos taurus; identical to SEQ ID NO: 41216

SEQ ID NO: 122162 - DNA, 201 bp, Bos taurus; identical to SEQ ID NO: 41217

SEQ ID NO: 122163 - DNA, 201 bp, Bos taurus; identical to SEQ ID NO: 41218

SEQ ID NO: 122164 - DNA, 201 bp, Bos taurus; identical to SEQ ID NO: 41219

SEQ ID NO: 122165 - DNA, 201 bp, Bos taurus; identical to SEQ ID NO: 41220

SEQ ID NO: 122166 - DNA, 201 bp, Bos taurus; identical to SEQ ID NO: 41221

SEQ ID NO: 122167 - DNA, 201 bp, Bos taurus; identical to SEQ ID NO: 41222

SEQ ID NO: 122168 - DNA, 201 bp, Bos taurus; identical to SEQ ID NO: 41223

SEQ ID NO: 122169 - DNA, 201 bp, Bos taurus; identical to SEQ ID NO: 41224

SEQ ID NO: 122170 - DNA, 201 bp, Bos taurus; identical to SEQ ID NO: 81523

SEQ ID NO: 122171 - DNA, 201 bp, Bos taurus; identical to SEQ ID NO: 81525

SEQ ID NO: 122172 - DNA, 201 bp, Bos taurus; identical to SEQ ID NO: 81526

SEQ ID NO: 122173 - DNA, 201 bp, Bos taurus; identical to SEQ ID NO: 81527

SEQ ID NO: 122174 - DNA, 201 bp, Bos taurus; identical to SEQ ID NO: 81528

SEQ ID NO: 122175 - DNA, 201 bp, Bos taurus
tggattgtttccatgtcttggctatcgcacaatagtcacctttcagctgcacctgtatctcccttactaacatgtaagctcctcaagggtaaggtttatgytttccgtatcttttagtgcctagagtagtaccctgcagagaatgtcataaagcctatgttaagtgcacagaaaataatatggcacctggctacaaaactg

SEQ ID NO: 122176 - DNA, 201 bp, Bos taurus; identical to SEQ ID NO: 81529

SEQ ID NO: 122177 - DNA, 201 bp, Bos taurus; identical to SEQ ID NO: 81530

SEQ ID NO: 122178 - DNA, 201 bp, Bos taurus
cagtccatggaatcgcaaagagctggacctgactaagtgagtttcacttcagttcatcccttttctgcttcctaaatggcagtgacggtggcctctgatcrtcattctaaaaatctggttgctttatgtcactgctttatgctggcttgaaaaacaccgcggcccttgagtcaaagcatttttgtgatttccttttttaaa

SEQ ID NO: 122179 - DNA, 201 bp, Bos taurus; identical to SEQ ID NO: 81532

SEQ ID NO: 122180 - DNA, 201 bp, Bos taurus; identical to SEQ ID NO: 81533

SEQ ID NO: 122181 - DNA, 201 bp, Bos taurus
catgtgggcctgctggccctctcccttcccttctcattgcccatcgtgtgcttgcacactgaggctaaacttgcagtcagcaagtctcattctctaactckatggaacctgccaagggccctttaaactctgggtatttccgtacctagcgtcttattcctttgtggagacaaacactcctttttgggtagctcttgtgtt

SEQ ID NO: 122182 - DNA, 201 bp, Bos taurus; identical to SEQ ID NO: 41227

SEQ ID NO: 122183 - DNA, 201 bp, Bos taurus; identical to SEQ ID NO: 41229

SEQ ID NO: 122184 - DNA, 201 bp, Bos taurus; identical to SEQ ID NO: 41230

SEQ ID NO: 122185 - DNA, 201 bp, Bos taurus
ccagggcggcagcagccaggctttcatcgtgaagcgcgtacgggcgggtcgctcacaggaacccaccgccaagcaagtacctcgtgatgcgcatgcacagygctgtacgcgatctcagctgttaaacacaggcattatttacaaagcgagaggtgagagagcctgaacactccgtcttggctaacttgctgtctccccaca

SEQ ID NO: 122186 - DNA, 201 bp, Bos taurus
gcattcgctttgctttggctgtggctcagtctgtagacagccttgccagtagcttacacttacgtgattgctccagtcagtcacccccagattataccatytggagcctggccgaactccagcgtgaaggtcaagatgccgcatgtgtagccgtcaggatactgacccctttggaccttatcttactttttgcccagcttt

SEQ ID NO: 122187 - DNA, 201 bp, Bos taurus; identical to SEQ ID NO: 41232

SEQ ID NO: 122188 - DNA, 201 bp, Bos taurus; identical to SEQ ID NO: 41233

SEQ ID NO: 122189 - DNA, 201 bp, Bos taurus
taaaggtctatgttcaccattcaaaacctacctggcctgaaaggatgatagactctagtgcttttccagaagagggcaatttgttttctgtttgtagtctrttgtgctgttggtaaatcctaggtttttctcttatgcacataagtcaaaggaggaggaatttgcttctggttcaataagtatttctcctggaaggtagga

SEQ ID NO: 122190 - DNA, 201 bp, Bos taurus; identical to SEQ ID NO: 41234

SEQ ID NO: 122191 - DNA, 201 bp, Bos taurus
ttccacactggggggtagagggagagccccatttgcaggctcatttctggcatcctatccaagttccctcctctgagctgtcatcatgcatcatgctaccyggcacattatgctcactgggggcctgcagatacttcaagcagtgaaaatcctgcttgtgataatacagcttttaagtctaactctgacaaacaagtgtga

SEQ ID NO: 122192 - DNA, 201 bp, Bos taurus
ggagttccatggtctcgtctccactcccccagaccccacaccgaccccctaaagtgcagggggtgcagtctcatcacccctcagactccagctgccccacytcatctcctcccttcaagggtcaccttccccaggacagaactggctccttgagtataaatactgtgagttcccatctgtctcctctgtagagccgtgacc

SEQ ID NO: 122193 - DNA, 201 bp, Bos taurus; identical to SEQ ID NO: 41235

SEQ ID NO: 122194 - DNA, 201 bp, Bos taurus; identical to SEQ ID NO: 41236

SEQ ID NO: 122195 - DNA, 201 bp, Bos taurus; identical to SEQ ID NO: 41237

SEQ ID NO: 122196 - DNA, 201 bp, Bos taurus
tgcacatgcaaaagtcacaagcagaaaagagctctattttcagtgcggtgagaaggaaaaattgagagcttagcatgggaggtctggccactggaagcctygggacgatgaggaaacttggattttgtcctgagggtaatgaagaattattttgtgacctgggaaaagtgatcagctttgcagtgtaggatgcctggtcag

SEQ ID NO: 122197 - DNA, 201 bp, Bos taurus; identical to SEQ ID NO: 41240

SEQ ID NO: 122198 - DNA, 201 bp, Bos taurus; identical to SEQ ID NO: 41241

SEQ ID NO: 122199 - DNA, 201 bp, Bos taurus; identical to SEQ ID NO: 81552

SEQ ID NO: 122200 - DNA, 201 bp, Bos taurus; identical to SEQ ID NO: 41242

SEQ ID NO: 122201 - DNA, 201 bp, Bos taurus; identical to SEQ ID NO: 41243

SEQ ID NO: 122202 - DNA, 201 bp, Bos taurus; identical to SEQ ID NO: 41244

SEQ ID NO: 122203 - DNA, 201 bp, Bos taurus
gcagtgtgaagctgaccccttgttcaggatgtgttgaagtcaaaattcctgggattgaggctctaaggtctctccctgccctggggctggagggagggccrgtctgagttcagggtgccttgctgtgaatccaggttccagctgtggctcccaccgtcttccgcagggcccagggccatgaggccttaggcctggctctct

SEQ ID NO: 122204 - DNA, 201 bp, Bos taurus; identical to SEQ ID NO: 41245

SEQ ID NO: 122205 - DNA, 201 bp, Bos taurus; identical to SEQ ID NO: 81556

SEQ ID NO: 122206 - DNA, 201 bp, Bos taurus; identical to SEQ ID NO: 81557

SEQ ID NO: 122207 - DNA, 201 bp, Bos taurus; identical to SEQ ID NO: 81560

SEQ ID NO: 122208 - DNA, 201 bp, Bos taurus; identical to SEQ ID NO: 81563

SEQ ID NO: 122209 - DNA, 201 bp, Bos taurus; identical to SEQ ID NO: 81564

SEQ ID NO: 122210 - DNA, 201 bp, Bos taurus; identical to SEQ ID NO: 81565

SEQ ID NO: 122211 - DNA, 201 bp, Bos taurus
cttcctgggcaagatgaggagctggcttaacctcggcagggtccaggtgtttatggcagtcgggctagagcacactcccccaaggagaaaataagttactyatgccagtgtttgtataggagaatgagtgacactcaaattcatacttaaaaaataaaagaaaaggtggttctctcctagttgttacttgcatgtattttg

SEQ ID NO: 122212 - DNA, 201 bp, Bos taurus; identical to SEQ ID NO: 41248

SEQ ID NO: 122213 - DNA, 201 bp, Bos taurus
aatgagtgccatggagactctgagaaaacccagttggtagaaaagtagaccagggcacagcaagattctgcttgcctgaagaaaggccagagactaaagaratcatgttccagtggtagcatatcagcctgggataggatggtgggtgcacaaacccctgggtcagaattctgactttgtctttgtacaaaggccattgca

SEQ ID NO: 122214 - DNA, 201 bp, Bos taurus
gcctagaaacagtgagtgaagaataaagcagaaatacagagacagcaaagagagagggggcctctgagggtcccacagtctggcatgtttctgagacccakctatattcctgtccttgggttccataaaacatccctctaatctaatgatattatgacactctattttcctttcagaaaggataggggctcaaacatgtac

SEQ ID NO: 122215 - DNA, 201 bp, Bos taurus
cttgggaaggcccttgaaaagagaagctttcagcttggtttgagggagatcaaaaccattcatttaaattccattccagtctgtttatgaaattttatttyaggatacttcagatttattgatcacttgctgaaaagagtgaagtctctgcatgggagcttctatttaattcatctatgttgctcatgctgtgatttcaaa

SEQ ID NO: 122216 - DNA, 201 bp, Bos taurus; identical to SEQ ID NO: 81574

SEQ ID NO: 122217 - DNA, 201 bp, Bos taurus
agtacttaacacgcatcgttttaagttttttattatttttttaatgttggctgtgctgagtctttattgctttgcatgggcttttctaattgcagcaggcrggggctactctctagtttcagtgctctggccccattgcagtagcttcccttgttgcagagtacaggctccagggtgcgtgggcttcagtcgttgtggctc

SEQ ID NO: 122218 - DNA, 201 bp, Bos taurus; identical to SEQ ID NO: 81578

SEQ ID NO: 122219 - DNA, 201 bp, Bos taurus; identical to SEQ ID NO: 81579

SEQ ID NO: 122220 - DNA, 201 bp, Bos taurus; identical to SEQ ID NO: 81581

SEQ ID NO: 122221 - DNA, 201 bp, Bos taurus; identical to SEQ ID NO: 81584

SEQ ID NO: 122222 - DNA, 201 bp, Bos taurus
ccaaaagcaagggtcagacggaacttaagctggctttgtggctctcatttactgccccctaatgaaagacatccttctgggatcctacccggccatgtgtrctcagcctggtgtctcccacggcttttgatgttttgacatgacacacagagagtcgatgtgcactaaaatcatcctattggtatataggctgttgtttaa

SEQ ID NO: 122223 - DNA, 201 bp, Bos taurus; identical to SEQ ID NO: 41263

SEQ ID NO: 122224 - DNA, 201 bp, Bos taurus; identical to SEQ ID NO: 41266

SEQ ID NO: 122225 - DNA, 201 bp, Bos taurus; identical to SEQ ID NO: 41267

SEQ ID NO: 122226 - DNA, 201 bp, Bos taurus; identical to SEQ ID NO: 41268

SEQ ID NO: 122227 - DNA, 201 bp, Bos taurus; identical to SEQ ID NO: 41269

SEQ ID NO: 122228 - DNA, 201 bp, Bos taurus; identical to SEQ ID NO: 41270

SEQ ID NO: 122229 - DNA, 201 bp, Bos taurus; identical to SEQ ID NO: 81595

SEQ ID NO: 122230 - DNA, 201 bp, Bos taurus
tttgcttgagcagtaacaacaagcagatgacttctcctttgtggcttaagaagcatagaaggaagatactatcagagacatatggcaacatttaattgtargtctcctgatggaaacattgaccctacagcataaaagataatatccacttcaaggtgaacttgccagagttgaatgaaacaatgtatatgagtgtgtctt

SEQ ID NO: 122231 - DNA, 201 bp, Bos taurus
atgaggaggcctgttgtgatggagatggcccgcatggctgtagtagaaggagggaaggggagaagtgggcactgagatcagagagggaggctgaggcgccrggagagggggcctgttgccctgagtgagatgggagctgctgttggtatggactggcctttgtgtatggggctgtcctcttgtgtgtcaggcttgctttga

SEQ ID NO: 122232 - DNA, 201 bp, Bos taurus; identical to SEQ ID NO: 81599

SEQ ID NO: 122233 - DNA, 201 bp, Bos taurus; identical to SEQ ID NO: 81600

SEQ ID NO: 122234 - DNA, 201 bp, Bos taurus; identical to SEQ ID NO: 41274

SEQ ID NO: 122235 - DNA, 201 bp, Bos taurus; identical to SEQ ID NO: 41275

SEQ ID NO: 122236 - DNA, 201 bp, Bos taurus; identical to SEQ ID NO: 81601

SEQ ID NO: 122237 - DNA, 201 bp, Bos taurus; identical to SEQ ID NO: 81602

SEQ ID NO: 122238 - DNA, 201 bp, Bos taurus; identical to SEQ ID NO: 41276

SEQ ID NO: 122239 - DNA, 201 bp, Bos taurus; identical to SEQ ID NO: 41279

SEQ ID NO: 122240 - DNA, 201 bp, Bos taurus; identical to SEQ ID NO: 41280

SEQ ID NO: 122241 - DNA, 201 bp, Bos taurus; identical to SEQ ID NO: 81610

SEQ ID NO: 122242 - DNA, 201 bp, Bos taurus; identical to SEQ ID NO: 41315

SEQ ID NO: 122243 - DNA, 201 bp, Bos taurus; identical to SEQ ID NO: 41316

SEQ ID NO: 122244 - DNA, 201 bp, Bos taurus
ttgagcccatttagataatccaagataatctccttatttacaaaattatttttattatttatttaattagctgctccgggtcttaattatggcctgtgagrtctttagttgcagaaggtgagctctcagttgcagcatgtaagatctacttccctgaccagggtccaagcccgggccccctgcattgggagtgcagagttg

SEQ ID NO: 122245 - DNA, 201 bp, Bos taurus; identical to SEQ ID NO: 41317

SEQ ID NO: 122246 - DNA, 201 bp, Bos taurus
tgctctctgcaactagagaaagcccacgtgcagcaatgaagaccaatacagccataaataaatatataataaaaattgctggaaaaaacaattacaaaacrtgtttcaaaatctgacgtagagagttccttgtgaatttttccataaggtggctgtagatgccccccaatcaaactcactagaaacacatctgaagctgac

SEQ ID NO: 122247 - DNA, 201 bp, Bos taurus
agcattttactctctgggtgctggaagcacaggtgtgggaactagagtagaagccaaaaatctaatgattttgaatttccacagaacagggctctgggctmtaaaaccctgagctgaagacacagtgggaataatgagaagcagttgcgttgttttctatcatttttaggttttagaggggtgcagggaaaagggggtcac

SEQ ID NO: 122248 - DNA, 201 bp, Bos taurus
ttcctcactctgcacgcctcctcaattcccccagggccaagactaagaaagggcagacacaaatagctgcatggtggaggctgacttaattgcttggtcayggtgttacttgggccttctctgaatccctcctccagatgcttacctaattttcctcctccttgctctattttttttccctttgaaagaaaatgtagatgg

SEQ ID NO: 122249 - DNA, 201 bp, Bos taurus; identical to SEQ ID NO: 41320

SEQ ID NO: 122250 - DNA, 201 bp, Bos taurus
gagcagcagacgaagcttcacgcttgctcactcacctcctgctgtgtggcctgggttcctaacaggccaggaacccaatctgtggcccagaggttttgggractcctgctttatttgggttcattgtcctgaacccactggcagccatttgttatgggtcatgtgattctgtaggactggccacttccccctgggggtgtt

SEQ ID NO: 122251 - DNA, 201 bp, Bos taurus; identical to SEQ ID NO: 41327

SEQ ID NO: 122252 - DNA, 201 bp, Bos taurus; identical to SEQ ID NO: 41328

SEQ ID NO: 122253 - DNA, 201 bp, Bos taurus; identical to SEQ ID NO: 41329

SEQ ID NO: 122254 - DNA, 201 bp, Bos taurus; identical to SEQ ID NO: 41330

SEQ ID NO: 122255 - DNA, 201 bp, Bos taurus; identical to SEQ ID NO: 41331

SEQ ID NO: 122256 - DNA, 201 bp, Bos taurus; identical to SEQ ID NO: 41332

SEQ ID NO: 122257 - DNA, 201 bp, Bos taurus; identical to SEQ ID NO: 41333

SEQ ID NO: 122258 - DNA, 201 bp, Bos taurus; identical to SEQ ID NO: 41334

SEQ ID NO: 122259 - DNA, 201 bp, Bos taurus; identical to SEQ ID NO: 41336

SEQ ID NO: 122260 - DNA, 201 bp, Bos taurus
tatatctcacagagggcctggaaaactgtaaggaatcaataaattatgagcaagagcaagagagtgggttggggaagaatgggagaatatcttcaatttakatttctgaatgactctaaggatgaaataacttgtattttttttaactagcttgagcattttctggtttcattcaaattatgatgtatacatagaaaaaac

SEQ ID NO: 122261 - DNA, 201 bp, Bos taurus; identical to SEQ ID NO: 41339

SEQ ID NO: 122262 - DNA, 201 bp, Bos taurus
tgtgttcggccacaataaaagaagcaatcacccctaaatagcttaaataaattaggagtcctaggttctttactgaataagaagcctaaaggaaaggaatycatggccagtctggtgtctcaaatatcacctggaaccgagactcgattcagctctacacactgccatacttaggatgtgttattcacagaaatacctctt

SEQ ID NO: 122263 - DNA, 201 bp, Bos taurus; identical to SEQ ID NO: 41342

SEQ ID NO: 122264 - DNA, 201 bp, Bos taurus
cttccaagaatcattttcttggtagagactggcctcctctacagcagctggagctggtgtgattctggagttataggatttgggttctctcagtaagtctrcggcccttagctatcaagcagaggggcaggtgtaagttggtccagggcagctgagaggaggtgggctgtttctttaataaaagagtcaaaggccagagca

SEQ ID NO: 122265 - DNA, 201 bp, Bos taurus
gcgtgggtcaacgatggcctactgcagggtcgggggcactgagtgcagcagtgggtgcatgggacctttagaatagtgggtcaccattaccttcattaccrccaccattggcctcaggtcaaacaactgggaaggaacacagccccacccaacaacagaaaattggattaaagatttactgagcatggccctgcccatcag

SEQ ID NO: 122266 - DNA, 201 bp, Bos taurus
gtgaaattattgaagtcatttgctccaatgggtgtgacaaaacatacaaagaggatggccagaaagatcatgatttgttattgcgtgaggcaaatcaaatragagaattgtgatactgtgtacctactgttggtgctgactagtgtgtgtgtgtatttgtagagatgtttgtgaggacgattaccaaatgtaaatggtgat

SEQ ID NO: 122267 - DNA, 201 bp, Bos taurus; identical to SEQ ID NO: 41346

SEQ ID NO: 122268 - DNA, 201 bp, Bos taurus
tttataaagaagggccatgtgcaaagtcttttcaatgctctgtgcagcacaactttataacagagatcattcggttgacagagcatattgtatacaaaatrgagataggttcaagttcagggccgccgtcttcacgatatcattctctgtatgtttatgtattgtacatatcactaatcctagagtaaaccggttgttcaa

SEQ ID NO: 122269 - DNA, 201 bp, Bos taurus
tagggccttagtgttttgttgattctaagcatcaaatcccagatgtcttcaaacttcagggtgcataattacctgggaacttataaatatgccaagttctrggcccatcctctgagaatgatttcaaggtctggaaatgaaggcccaaactctgcattcttacctcccccactatctcctggcgagtttgatgcccatggt

SEQ ID NO: 122270 - DNA, 201 bp, Bos taurus
catccgcctcggaaaagtcctttcacagcatggtcctcaatactttttctaaggctacttctcagacatcactgaattctttctttggggatcattatttytgcaagcatgagctcttgacaaattcttcatggcaatcagttttctcttaagccctcctccctaaatagaaacagttgatcataaccccggggggaatta

SEQ ID NO: 122271 - DNA, 201 bp, Bos taurus; identical to SEQ ID NO: 41348

SEQ ID NO: 122272 - DNA, 201 bp, Bos taurus; identical to SEQ ID NO: 81682

SEQ ID NO: 122273 - DNA, 201 bp, Bos taurus
tctatttctgctctcctcttgttttccttcatctaccaaaaaatggctcttcattacagcacttgatacttcttaagagtttccctcaaaaacccaggctmataagagattccaatccaacaggacttctattacctgtggcttctgcacttgccctgtagtcctcctttccttccccacactgtgctgtgtggaacttgt

SEQ ID NO: 122274 - DNA, 201 bp, Bos taurus
accaagtaactctatgtggccaagcaaaacattttatgattcattcctaaatttaagctggtaatagtttttctgttacatgaagctgaaataatgtaccygattcaagcagatcaactgaagggccacagtaattggtccaaatcaggttagaaaaagtcctctagaacttttgaaagtgagctgtaaagaaaaaaaaat

SEQ ID NO: 122275 - DNA, 201 bp, Bos taurus; identical to SEQ ID NO: 81689

SEQ ID NO: 122276 - DNA, 201 bp, Bos taurus; identical to SEQ ID NO: 81691

SEQ ID NO: 122277 - DNA, 201 bp, Bos taurus; identical to SEQ ID NO: 81693

SEQ ID NO: 122278 - DNA, 201 bp, Bos taurus
cctctcccatattatcactttttccttcttcattgatcatcccctaagaatacagacatagtaaaaggaaacatgtatcaagtcatggaggaaagatattrtataatatggtttgtaaattttgtgtaagtccaccaaatgaaggaaaatttgtatgacaaagactatcaagaaaaaataagtcatattatgaaggaattg

SEQ ID NO: 122279 - DNA, 201 bp, Bos taurus
actagaattagcttatccagaggatatgatctagtaataattgagagcctgagtagaacatttggtttaagttgtagcctatagacaagacctggctatgmtgattaagtcactggtaacatgtttccgaagcacagacttagtaaaatgatataatgccttattaaacagtgaaagatacacaaattgaacaatacacat

SEQ ID NO: 122280 - DNA, 201 bp, Bos taurus; identical to SEQ ID NO: 81696

SEQ ID NO: 122281 - DNA, 201 bp, Bos taurus; identical to SEQ ID NO: 81697

SEQ ID NO: 122282 - DNA, 201 bp, Bos taurus; identical to SEQ ID NO: 81698

SEQ ID NO: 122283 - DNA, 201 bp, Bos taurus
taaagcaaaagtctgctcgctgtgttctagccgtggatattatgtaaggctaaataggatgtccacacctgactctcctatttcacactgaactaaaaaayggaaaaatatgaaagaagttccacattacagaggagatgctgctcgataatacagtaattcagatctatataagacttttgtagctattattcagggtta

SEQ ID NO: 122284 - DNA, 201 bp, Bos taurus
gtactgccttttatttttgtgtcttggcctctgtaattacttctgtaccattgctacatctgtcttttatataattcaccaccaccactaccaacaacagsctaaagttagaattggccaattactgtatatgatgaagaatataagtactagatggtatagatctttcatattggtctgtgttataaactattctccagg

SEQ ID NO: 122285 - DNA, 201 bp, Bos taurus
tttcacaaattgaacataacagaagctgtccatatggccatatgaaaaaaacaaactgggaaattaccaagtgtgaactccctcaggtggtaaaagcttaytgtgttctagaaacagaaaggccaaagtgcagagatctaacaaatgcaaaggaaaataatatgaagtagagttgacagttaggcagtagaaatttcatgt

SEQ ID NO: 122286 - DNA, 201 bp, Bos taurus
gcgtgctgcaattcatgggctcgcaaagagtcggacacgactgagcgactgaactgaacagaaacttactaaataataaaatagacatgacttcactagakaatgagaatgtttaggcctaattcattggtcactctgcttctcattcctatttctttatccaatgctctgaatatttttttgttttctacatatttccca

SEQ ID NO: 122287 - DNA, 201 bp, Bos taurus
ataggaaaagcatgaatattagcattttcttcatactcaggatctcaaatgccccctgcagttacatatgtcctttcaccttcctagctattcagctttcrgtgtgtgtgtgtgtaactgttagtcacttggtcgtgtccaactctttgagaccacatggactgtgtactcttgtcttcccctaaacccccacctctaact

SEQ ID NO: 122288 - DNA, 201 bp, Bos taurus; identical to SEQ ID NO: 81701

SEQ ID NO: 122289 - DNA, 201 bp, Bos taurus; identical to SEQ ID NO: 81702

SEQ ID NO: 122290 - DNA, 201 bp, Bos taurus
ttctggagtgtggatgagaaattactaaatttaaagggttttcaatttaacttaattgtgtctatatctgctcatttcacatttgaagatctgtcaagggraaaaaaatgtgattaaatttcaaaatatccttagtgattacatgagtcaacaagaaatgtaaactcttacagttgatgaaaagagtagagcacccaacag

SEQ ID NO: 122291 - DNA, 201 bp, Bos taurus; identical to SEQ ID NO: 81704

SEQ ID NO: 122292 - DNA, 201 bp, Bos taurus; identical to SEQ ID NO: 81706

SEQ ID NO: 122293 - DNA, 201 bp, Bos taurus
tacaggaaaatctcctataataagtaagtgaaggccgttacaagaacccttgattactgccactaatggaacttcttctgaagtttcagccactgatgaasaggtaggaggccagggaatcagctgacaaaggaagacaagcatcagggctatacggtagatgctcaaggaaaccggaaactgtgaggccccacagaggct

SEQ ID NO: 122294 - DNA, 201 bp, Bos taurus; identical to SEQ ID NO: 81707

SEQ ID NO: 122295 - DNA, 201 bp, Bos taurus; identical to SEQ ID NO: 81708

SEQ ID NO: 122296 - DNA, 201 bp, Bos taurus; identical to SEQ ID NO: 81709

SEQ ID NO: 122297 - DNA, 201 bp, Bos taurus
ctttgggaatatagtggacattggccactggattttgcaacaggtagctctagaagtgttggctcaaggagccagttttatcgttagttgttaaaataccyaacagctattggccacttaccatgtgccaggcactgtgctcattatgttttgtgtttaacatgcattgtgtttacataacctatgaggtattatccatat

SEQ ID NO: 122298 - DNA, 201 bp, Bos taurus; identical to SEQ ID NO: 81711

SEQ ID NO: 122299 - DNA, 201 bp, Bos taurus
aatataatctgaggtccacttgggagttgtggcccatgacagaagtggagtgactctacgttttgatactaacagtcaagccattgagacagatcctgcckttgggccttgagaagctggaatcactgggtcagaaactcaaattaagatccagtaacatgttggacttccctggtggtccagtggttaagactccacact

SEQ ID NO: 122300 - DNA, 201 bp, Bos taurus
gcattgtcttggacatttctctatatctttgtgtgatttttccatctcaatagcttttctttttcttttttaaataatttatttggctgggacacgtgggrtatttgatctttgtagtagcacagggaatctagttccctgaccagggatcgaaccctagccccctgcaatgggagtcttagccactggaccagcagggaa

SEQ ID NO: 122301 - DNA, 201 bp, Bos taurus; identical to SEQ ID NO: 81713

SEQ ID NO: 122302 - DNA, 201 bp, Bos taurus; identical to SEQ ID NO: 81714

SEQ ID NO: 122303 - DNA, 201 bp, Bos taurus; identical to SEQ ID NO: 81715

SEQ ID NO: 122304 - DNA, 201 bp, Bos taurus
ggtcatatccctgatcaaattcaatccagaggcaggggagatacagctgtgaacccggtgactcaagtcctgcctttttggcccattggaatgaatggtcmcagaacaaatcagtgcagcctgaggaagcacacattcctcatttgtgtttcagggctcccctgcacctcactgtctcctaggcctcatcgcaaagcacct

SEQ ID NO: 122305 - DNA, 201 bp, Bos taurus; identical to SEQ ID NO: 81716

SEQ ID NO: 122306 - DNA, 201 bp, Bos taurus
gctgactcgcaaggaaaatgtgatcttttgtaacaggagggagatcagaccaaagaaagttttgtttcctgccaggaaggccgttctggagtgggtcccgrggctctggggagcttataaaaatagaagaagccactgactgcttttacaaagagggctagggtcaattctgctcagaatgcaggcctacaacagcttggt

SEQ ID NO: 122307 - DNA, 201 bp, Bos taurus
cttaagaccactcagtggttgttcctatccattcagtggcctgagcagtgggagctgtaaacccattttgagctacaggctgagggctctatcttccattrggaactgaataggcatggcagggccctgtgccttcagacccacctgcaacttcagaatgggctaccctggtggctcaaacagtaaagaatccacctgcaa

SEQ ID NO: 122308 - DNA, 201 bp, Bos taurus
tgcacttgctacgtagcttatctaaaataatcatcatttggaccctctcacactggctccttcccatttttgaagttccaacttcagtttcatctcctcaraaaggccttcctccaccacctaagctaaagcattttcacattttctcgaattccatcctctcttcattacgttaccatattttaacttctctacagcagt

SEQ ID NO: 122309 - DNA, 201 bp, Bos taurus; identical to SEQ ID NO: 81717

SEQ ID NO: 122310 - DNA, 201 bp, Bos taurus
aggacggggcacagtggagggcctcatccaggtcggtcctcaggaaacaataaatagatggaagttgtcttctgtcactctcagggcagctgctggctctyagcactagaaacaaggcctcaaacccaaaagggcccggaaaatgcgcagcaatgctcatccatgggcccagaaggtactgatgacttgaaggtaacttgg

SEQ ID NO: 122311 - DNA, 201 bp, Bos taurus
ctccagagccccatcccttgtgccctagaagaccctgtgagcctcaatccaggcaagggagctcaggacaggctctgcagacagaggaggggcagggccaygggctgggtccactcacccacaatctcattctcttccagattgatgttctccagcgcaggcagggtggtgagctgctcggggaagtcgtggaactggttc

SEQ ID NO: 122312 - DNA, 201 bp, Bos taurus
gtggctgagacagatgtttcctgcagctggccactcagcctcctgccctatttttagctccattgttacccgccccaggcatctggctgccagcggtccgwgagaggctgtggccctggaaggggtgctcttccctgggtccagcttgttctctgcctgctgcaggtccctgggttaagcttcccagtgtctttggggaaa

SEQ ID NO: 122313 - DNA, 201 bp, Bos taurus; identical to SEQ ID NO: 81721

SEQ ID NO: 122314 - DNA, 201 bp, Bos taurus; identical to SEQ ID NO: 81722

SEQ ID NO: 122315 - DNA, 201 bp, Bos taurus; identical to SEQ ID NO: 81723

SEQ ID NO: 122316 - DNA, 201 bp, Bos taurus; identical to SEQ ID NO: 81727

SEQ ID NO: 122317 - DNA, 201 bp, Bos taurus
actaaggcaggttactctccttatccaatcccaggatcaaccccgatgcattaacactattctgataaacccaaatccacctgtaccttcattcaagtgaraagcacaggcccttttcaactctgaaaactctagaattcaacgagtggggctcacactagaaatattagtagcacttggaaatatctttgaaatgcagat

SEQ ID NO: 122318 - DNA, 201 bp, Bos taurus
gatctcaccatgagcattgccaggacctttaaagcaaccccttcctgtgcctgcttggcttgttccctcttcatcaggagtggggccacccctccttcagractgtttcaaagtgagaacattctccagaagagtctgagaagaactttaagagaggggccctgggagcatcagggctagtttatgcttgactttgaatga

SEQ ID NO: 122319 - DNA, 201 bp, Bos taurus; identical to SEQ ID NO: 81729

SEQ ID NO: 122320 - DNA, 201 bp, Bos taurus
ccaaggtgggtatcccattgccaggcctgtaataagagtcacacagtcttttgtgctcttcaactgactccccacccccatgagcattctcatcacccagmaaactggcctcttgccttcccttctgtaggcatctctgaatagcatcccaccggcccacaagccctcattgcctaagccagccctggagagagactccaa

SEQ ID NO: 122321 - DNA, 201 bp, Bos taurus; identical to SEQ ID NO: 81731

SEQ ID NO: 122322 - DNA, 201 bp, Bos taurus
ggatgcttcaataaagttcacccaatgctagatatcttttatctgaaaatgaagtaataacccacatatgtgtccaagcagccaagtgtccccagcccttrgatccaggagcagcaggaggaaggccacaggaggggcttccagggaacctggcctgggcggccccctgggcactggacaggccagcccacactcctggct

SEQ ID NO: 122323 - DNA, 201 bp, Bos taurus
cacaggcaatcagtaaatgcaatgggaggtaagaaaacgatggagagggcttgctttctagacaagccctttagaagagacagacactgagttgggcctcrtagcaagtccaagacttagagaagaggaggagggagggcagcgtgaaagcagaaatgggtctggagggccaaggagatcggtttagatgtatgcagggtt

SEQ ID NO: 122324 - DNA, 201 bp, Bos taurus
ctatcaccacattcccattccctcagaggggagagggtaatctaggcatgaggacagagtagtagagttgattcgggctggcacatctcggaggacaggaragggacctgggccccaggagagaaaggcttgaggcctggagaacctgcccccaaccaattctcagcctccaaaaattgtgacttttaccatcattaattc

SEQ ID NO: 122325 - DNA, 201 bp, Bos taurus; identical to SEQ ID NO: 81732

SEQ ID NO: 122326 - DNA, 201 bp, Bos taurus; identical to SEQ ID NO: 81734

SEQ ID NO: 122327 - DNA, 201 bp, Bos taurus; identical to SEQ ID NO: 81755

SEQ ID NO: 122328 - DNA, 201 bp, Bos taurus; identical to SEQ ID NO: 81756

SEQ ID NO: 122329 - DNA, 201 bp, Bos taurus; identical to SEQ ID NO: 81757

SEQ ID NO: 122330 - DNA, 201 bp, Bos taurus; identical to SEQ ID NO: 81758

SEQ ID NO: 122331 - DNA, 201 bp, Bos taurus; identical to SEQ ID NO: 81759

SEQ ID NO: 122332 - DNA, 201 bp, Bos taurus; identical to SEQ ID NO: 81760

SEQ ID NO: 122333 - DNA, 201 bp, Bos taurus; identical to SEQ ID NO: 81761

SEQ ID NO: 122334 - DNA, 201 bp, Bos taurus; identical to SEQ ID NO: 81762

SEQ ID NO: 122335 - DNA, 201 bp, Bos taurus; identical to SEQ ID NO: 81763

SEQ ID NO: 122336 - DNA, 201 bp, Bos taurus; identical to SEQ ID NO: 81764

SEQ ID NO: 122337 - DNA, 201 bp, Bos taurus; identical to SEQ ID NO: 81765

SEQ ID NO: 122338 - DNA, 201 bp, Bos taurus; identical to SEQ ID NO: 81766

SEQ ID NO: 122339 - DNA, 201 bp, Bos taurus; identical to SEQ ID NO: 81767

SEQ ID NO: 122340 - DNA, 201 bp, Bos taurus; identical to SEQ ID NO: 81768

SEQ ID NO: 122341 - DNA, 201 bp, Bos taurus; identical to SEQ ID NO: 81769

SEQ ID NO: 122342 - DNA, 201 bp, Bos taurus; identical to SEQ ID NO: 81770

SEQ ID NO: 122343 - DNA, 201 bp, Bos taurus; identical to SEQ ID NO: 81771

SEQ ID NO: 122344 - DNA, 201 bp, Bos taurus; identical to SEQ ID NO: 81772

SEQ ID NO: 122345 - DNA, 201 bp, Bos taurus; identical to SEQ ID NO: 81773

SEQ ID NO: 122346 - DNA, 201 bp, Bos taurus; identical to SEQ ID NO: 81774

SEQ ID NO: 122347 - DNA, 201 bp, Bos taurus; identical to SEQ ID NO: 81775

SEQ ID NO: 122348 - DNA, 201 bp, Bos taurus; identical to SEQ ID NO: 81776

SEQ ID NO: 122349 - DNA, 201 bp, Bos taurus; identical to SEQ ID NO: 81777

SEQ ID NO: 122350 - DNA, 201 bp, Bos taurus; identical to SEQ ID NO: 81778

SEQ ID NO: 122351 - DNA, 201 bp, Bos taurus; identical to SEQ ID NO: 81779

SEQ ID NO: 122352 - DNA, 201 bp, Bos taurus; identical to SEQ ID NO: 81780

SEQ ID NO: 122353 - DNA, 201 bp, Bos taurus; identical to SEQ ID NO: 81781

SEQ ID NO: 122354 - DNA, 201 bp, Bos taurus
gaaccattcaacttcagcttctccagcattagtgcttgtggcatagacttggattactctgatattgaatcattggccttggacacaaactgaaataattstgtcatttttgacattgtactaaagtactgcatttctgattcttttgctgactatgaggcctgctccttttcttctaagtgattattgcctgaagtagta

SEQ ID NO: 122355 - DNA, 201 bp, Bos taurus
tcctttacttgacaattatctttttaacccccttgttgtaccagatattggtttagagatattaatgtgctctcacgtgtattagttggcctcagctacartaacaaaatacaaatccaagagaaagtttccagaaggctttgtttctcataagaccttgcttgtgcacttgtcgatggcaactatgtgccatgttctttc

SEQ ID NO: 122356 - DNA, 201 bp, Bos taurus
actggagtgggttgccattgccttctccaatattggtctgctaggcctgccttaacagagtaccacagactgggcagcttaaacaatagaccttggttgtycacagttctggaggccagaagtttgagaccaaggtgttgaaagggtaatttccttttgagggctgtgaggagaaatctgttcagtgcctctgccctagct

SEQ ID NO: 122357 - DNA, 201 bp, Bos taurus; identical to SEQ ID NO: 41353

SEQ ID NO: 122358 - DNA, 201 bp, Bos taurus
agacagctctcccagcagctggcagactgagtaccttggtcctgaagggtggccctgggtggtgtaccacagcacagcacccactctcaggctcctatatrtcaaagatgtcaaagatggagaaggcctgtttaacaagctgctccagaaacaagcacttgtgactttatgttgatctgtttcatgctgtagtttgcctct

SEQ ID NO: 122359 - DNA, 201 bp, Bos taurus
gatcactgacttgtacactttaaatggatgcattaatggtacatgctttttctacctcaataaagttttttaaaggcggtagattaaatgttccagtaggragaaagagtctgggaaaccagaaatttggggaagagctgaccggacatccagtggacccagacctatgctgtgctgggcagcctcctactccatcaatgg

SEQ ID NO: 122360 - DNA, 201 bp, Bos taurus; identical to SEQ ID NO: 41356

SEQ ID NO: 122361 - DNA, 201 bp, Bos taurus
agaccctgcagggtgcctgggctcaaaggagatgaagacagaacctggaaattctctcagtgacactatctcatagtgaaaagtcagtgagatgaaggccrtgaaggcattagaaagagcccaagctccaggcaaggtcagccaggttcaaatctcagctcttccattcatatgctgtgatctaggacaagttacatggcc

SEQ ID NO: 122362 - DNA, 201 bp, Bos taurus; identical to SEQ ID NO: 41360

SEQ ID NO: 122363 - DNA, 201 bp, Bos taurus
ccctcattccttttgttggtaaggttactggagaaaacaagcggtaaggaatgaccttagtaattgttgccagaggtcaagttcatgggctgattaccagragaatatagctgtgactctctaagctccagaggtgtttcctcacttcatttgacccttggccccttattgtaactctgcttaggttctcaactttagact

SEQ ID NO: 122364 - DNA, 201 bp, Bos taurus; identical to SEQ ID NO: 41362

SEQ ID NO: 122365 - DNA, 201 bp, Bos taurus
ccacaccagctgcccccgcggccccacagtagccagaatcccctctcctctgtctgccttccccatcagattatctgtgttctgttccttgtaggaaaggrtgctatggccacctggtcaaggatgcccactgagatgacagtccttggctatagtttctcttatgaaggagagaagaagccatgataaactttgcaaggc

SEQ ID NO: 122366 - DNA, 201 bp, Bos taurus; identical to SEQ ID NO: 41366

SEQ ID NO: 122367 - DNA, 201 bp, Bos taurus; identical to SEQ ID NO: 81799

SEQ ID NO: 122368 - DNA, 201 bp, Bos taurus
cggccacaactggagaaagccctcgcacagcagaagacccagtgcaaccaaaaatagtaatagtagtgaagtttttaaataaggcactgaaggagcaggtyggtaagggccctctcccgagcatgaagcactgttcagccactttcccctgaatctagtgagttcttacagcactggtcctcaaacttactgtctacagag

SEQ ID NO: 122369 - DNA, 201 bp, Bos taurus; identical to SEQ ID NO: 41368

SEQ ID NO: 122370 - DNA, 201 bp, Bos taurus
aggatggaagttgctaaaatgatcctggtggggggtgctgaggccaggctcaccacttttcagacacatctcaacagagcaggggcccgaggtggcccccrgcagtcagagacgcatcaaccatcatgtcctcagtgggcatcttagggaagcccaagagtcactgatctgcagaggagtgaagcccttgtccccctggcc

SEQ ID NO: 122371 - DNA, 201 bp, Bos taurus; identical to SEQ ID NO: 41369

SEQ ID NO: 122372 - DNA, 201 bp, Bos taurus; identical to SEQ ID NO: 41370

SEQ ID NO: 122373 - DNA, 201 bp, Bos taurus; identical to SEQ ID NO: 41371

SEQ ID NO: 122374 - DNA, 201 bp, Bos taurus
aaattaactcgagacattacgaagagtaatttacttttcctgccttgacttcctgaccatctattcatttctttaacccttggtatctgaatttcaccttygcaaaggtcacctgtaacctaataaacacttttgggcctcctttctaagtcaacttgaactttttgtagctttcagcctcaacccatcattcttggaatg

SEQ ID NO: 122375 - DNA, 201 bp, Bos taurus
gagaaatgactctgaacaggagagcatggggccagaaccactgaggctcataatgccaagccaaggggcttaggattccggctgtgagcactatggagctmtagctgattcttgagttaagtgtctcatatggtacatgatgtcctccaggtagaaaagtctgatagcaatggtcaaaatgatttgtaacaagagccaaga

SEQ ID NO: 122376 - DNA, 201 bp, Bos taurus; identical to SEQ ID NO: 41376

SEQ ID NO: 122377 - DNA, 201 bp, Bos taurus; identical to SEQ ID NO: 41377

SEQ ID NO: 122378 - DNA, 201 bp, Bos taurus
attctgccctcctccttaccccctatcccctgtggatcatgaaatcaaagaggacctcacgcctggccagctcttatctccattggtaccccaggatgccyggctttgcattttctattttcagaaggcttaggttaatctgaaagtcctgccagagaccacccaccacccttaaacaaacagctcacctttcagcccaga

SEQ ID NO: 122379 - DNA, 201 bp, Bos taurus
agcacctggccctgaacctttcaaaagtctagttctttttttaatcccttgctgccaagcgccgactggctgctgggcccctgtggctggttcctgcacamtctgtgtgtttcattttcatgatgagaggcagattacaggtctgctgcatgcccaggttcggcccggtgggcactgcataggcacactcatagagagtgc

SEQ ID NO: 122380 - DNA, 201 bp, Bos taurus
cacgagtgtgactctggtggaacagtgggggcaaactcctgactggagtgactctaagggaggacagggggcgaggaagggccggtggggagtagagacckcttcctactctttcaaggaattgtgctggcacgtgaaagcccacatgtgcagctgctcctggaacacctcatgaaccatctgaaatcaagctgtggacca

SEQ ID NO: 122381 - DNA, 201 bp, Bos taurus
ccagccatctgtgattgcatttcaactggacctgcagaacagtcagaaagaccccctgagcagcatgtacagcatctctttggagcctccaagaacacttkgcagcatgtagcactggcccattacacaaggagggaactgaggccctgggaggaagtcagtgattctccactggcagaggtctgtaagtcccggagctaa

SEQ ID NO: 122382 - DNA, 201 bp, Bos taurus; identical to SEQ ID NO: 41378

SEQ ID NO: 122383 - DNA, 201 bp, Bos taurus; identical to SEQ ID NO: 81813

SEQ ID NO: 122384 - DNA, 201 bp, Bos taurus; identical to SEQ ID NO: 41381

SEQ ID NO: 122385 - DNA, 201 bp, Bos taurus
gtaccgtgtgctgcacgttaaatcttgctgagcccctggtagccgagcttgtgcacagtggacagtaagagtatccccatgctcctcctgccttcccagcrttggccactgcaagcccaggttgaagtcttgggtctttgggcaatgtgcagcccacagagtggacatagttcctctcatggagctgatggtctggttcag

SEQ ID NO: 122386 - DNA, 201 bp, Bos taurus
catgaggtcttctaaaggctgccctgtgggtgagcccctgcctacctagacgcaccagagtttcctgcaaaacgagcagtgcccatgcctggggccttgayggtctccgagactggtcgcttgtgtgggtaggatgaccatggtcctgctgctagctacttccctgaatgtgtgcccagatccactacatcctacccccgg

SEQ ID NO: 122387 - DNA, 201 bp, Bos taurus; identical to SEQ ID NO: 41382

SEQ ID NO: 122388 - DNA, 201 bp, Bos taurus; identical to SEQ ID NO: 41383

SEQ ID NO: 122389 - DNA, 201 bp, Bos taurus; identical to SEQ ID NO: 81815

SEQ ID NO: 122390 - DNA, 201 bp, Bos taurus; identical to SEQ ID NO: 41384

SEQ ID NO: 122391 - DNA, 201 bp, Bos taurus; identical to SEQ ID NO: 81816

SEQ ID NO: 122392 - DNA, 201 bp, Bos taurus
ggggtcccaggccctctgtcactcagcaacggtgcgacagggagtattccgaggctctgttatctcagaactgactgtgcagccacgtggaggagtgaggrgctggggcctcccggggcagtctgctggggttctgtgggcccgccacgcccgctagccctgagcagctgcgtgcggcagtctggaccagggtctgtaggg

SEQ ID NO: 122393 - DNA, 201 bp, Bos taurus; identical to SEQ ID NO: 81818

SEQ ID NO: 122394 - DNA, 201 bp, Bos taurus
accaacctccacatggactgcagcccagtttcaggccatctggatggctaagcaaatctcaaaccctgaaattgtattaagatgatcctgggttgctggtrctaccaggccctggcaagaagtgaaaaataaagtcttccatagaggaaaataacatcatgcttggcctcaaattatttctacaaataagttttctaatac

SEQ ID NO: 122395 - DNA, 201 bp, Bos taurus; identical to SEQ ID NO: 81821

SEQ ID NO: 122396 - DNA, 201 bp, Bos taurus; identical to SEQ ID NO: 81827

SEQ ID NO: 122397 - DNA, 201 bp, Bos taurus
tagctgctggcgtgtggccctttgtctctgctgcactgggggcggcttccctgggcactggtgcgtcttccctccgctggtggattccctgtgtaagctcmcatgcttgggccacctgagctctcgatccactgcagaattctgacttttgacacgcagggttcagtctctcagccgctagccctccacccctcacttcgc

SEQ ID NO: 122398 - DNA, 201 bp, Bos taurus; identical to SEQ ID NO: 41394

SEQ ID NO: 122399 - DNA, 201 bp, Bos taurus
gcgcttcaggactgcctgagagacgccaggcagtctgcacctctctgctctctgatgctgggggatgtgttggggacttggggaggggggacagaggagargactgggttcactaatccacagggcagacacagatgccaggtggattggtcactgcccagctgctcccaaaccccagtgtaccctgtgtgctcctgcccg

SEQ ID NO: 122400 - DNA, 201 bp, Bos taurus; identical to SEQ ID NO: 41396

SEQ ID NO: 122401 - DNA, 201 bp, Bos taurus; identical to SEQ ID NO: 41397

SEQ ID NO: 122402 - DNA, 201 bp, Bos taurus
atacagcaggatccatatggtatcacacagcatgtgtgtctgtgggagcttcacccccgctctcggtccagttggtcagcatttcaggagaaaatctgacyctccctgtggccattcctctctcctcctccctgcactgaaattttcaccaggcaaatttgcaggatcttttttctatgattgttttcttgataaacagtc

SEQ ID NO: 122403 - DNA, 201 bp, Bos taurus; identical to SEQ ID NO: 41398

SEQ ID NO: 122404 - DNA, 201 bp, Bos taurus; identical to SEQ ID NO: 41399

SEQ ID NO: 122405 - DNA, 201 bp, Bos taurus; identical to SEQ ID NO: 41400

SEQ ID NO: 122406 - DNA, 201 bp, Bos taurus; identical to SEQ ID NO: 41401

SEQ ID NO: 122407 - DNA, 201 bp, Bos taurus
tcgggcatacatttattttatatttcactaaagttccttaacatatgtaaaaattattcatgttttacataaacaaagacttgatgatgattgacctggarggtagggaataaaacagaatgattatgtctacatttgtctctttctgaaacccaagtactaagctaccattctctatctgttctactcttctgttatcta

SEQ ID NO: 122408 - DNA, 201 bp, Bos taurus
ctgctctgtcttaaaaccccatacgcataacttccagaatgaccaccacatattcatgcaacacatgtggtatgcaatactcagagaatctcaaagcatgrtgtattcatcatgtatttatagtttgtttatagttcttcccagtccggctgtagtttaatactcagggttatttcttaacattagctgtgttgcctgtca

SEQ ID NO: 122409 - DNA, 201 bp, Bos taurus; identical to SEQ ID NO: 41497

SEQ ID NO: 122410 - DNA, 201 bp, Bos taurus; identical to SEQ ID NO: 41499

SEQ ID NO: 122411 - DNA, 201 bp, Bos taurus
atggcagggaaaataatggcatttgagtgatgcataacctttcggtgggacaaaggtcatggctatgattcaggtcttaaatcttttagccaagttattaycatagattaagcacttataaaattatttaaaattctaatatatccagatctcttggttttgccttcagaattgctttacagtagtagactgaagtcaacc

SEQ ID NO: 122412 - DNA, 201 bp, Bos taurus; identical to SEQ ID NO: 81951

SEQ ID NO: 122413 - DNA, 201 bp, Bos taurus; identical to SEQ ID NO: 41501

SEQ ID NO: 122414 - DNA, 201 bp, Bos taurus
gctattcagtcccttgtgactcagttctcttgaacatgactccatttagtttatactccaacaaagtgaagtttttccatctgcaaagtaagacttagacmcctgaccactacctcctgacatgccatctctctgttaggtaagaggaatctaacacttcatgaacatcattaatccaacagatattcattgaaagcccac

SEQ ID NO: 122415 - DNA, 201 bp, Bos taurus
aagcctaaacaaattcattccaatttgcatagctcttaggttattaaattcttgggaaatgtcctaactcttccatgtgtatcaactttcaatctaattcractaaccactcttgaacacttagtcctgggcctctgctgagcacatgcctgtgtcttttctcagaaatcatttcactagatctcggtcacattgtatttt

SEQ ID NO: 122416 - DNA, 201 bp, Bos taurus
gaagtttctcttctcatcacagatggcctgtcttttgagatacatttcacggtcctttcagtgcgtttccagagtctgaaaagaagagccgtcaccacgcrtgcgccactgtgatcctcacggccaggatcacgggcctcattttccccatgtgtttgcagatgtgctactttgatctacattccattctgacgtgcccgc

SEQ ID NO: 122417 - DNA, 201 bp, Bos taurus; identical to SEQ ID NO: 41502

SEQ ID NO: 122418 - DNA, 201 bp, Bos taurus
aattaaatctcatccctcactgcatctaaacccaagaaaggtggtctcctcttcctcccataaatccccccatcccaggcctctctctcactggttccccraacatcctgcagtgtcacatgtgaatgcagctctgggctctgacagaggggccccttggaggccagagatgggatctctcattcccatgttgatgctgcc

SEQ ID NO: 122419 - DNA, 201 bp, Bos taurus
tgaaagtactttggaaccttataaactgtgacgagttctggttttgtttttaagcttcatattaatttgctagggccactatagcaaaatagcacagactrggtgttttaaacaacagaaatttttttttttcataactgtggagactagaagtccaagattaaagtgccagcaggtttggtttcttctgaggccactctc

SEQ ID NO: 122420 - DNA, 201 bp, Bos taurus; identical to SEQ ID NO: 41505

SEQ ID NO: 122421 - DNA, 201 bp, Bos taurus; identical to SEQ ID NO: 41507

SEQ ID NO: 122422 - DNA, 201 bp, Bos taurus; identical to SEQ ID NO: 81958

SEQ ID NO: 122423 - DNA, 201 bp, Bos taurus
gcagaaaggcttctttggcgctttgtaagatcgtgatgcatcaaggaaacattccagagaaatgtagataatgccagcccaggccgggagctcagggatgmgtgagcagttcggtaactggagaggagacaccagggcagcaggaggctgggacaggagctctcgtgttctgaagagaaaagagtttccatctgctgctcc

SEQ ID NO: 122424 - DNA, 201 bp, Bos taurus
tgcaggaccaggggtcctagatctagtgttggtctgctggtggggggggccagttcctgacatgcctttctgctggatctagggtgtcctaagcttaatgktggcccactggatggtggggctgtatcccagggacagctggcttagaagtaaatggagccagctcctgacatgcctttctgctggatccaggatgtccca

SEQ ID NO: 122425 - DNA, 201 bp, Bos taurus
ttgtttattcagttacttaggatatattctgtcttctgtttttaccacaggcaacttcagagtggaccttggattaccctcccttttttgcgtggtttgartatgccctgtcacatgttgcgaaatattttgatcaagagatgctgaatgtccgtaatctgaattactccagctcaaggaccttactcttccagagatttt

SEQ ID NO: 122426 - DNA, 201 bp, Bos taurus; identical to SEQ ID NO: 41511

SEQ ID NO: 122427 - DNA, 201 bp, Bos taurus; identical to SEQ ID NO: 41512

SEQ ID NO: 122428 - DNA, 201 bp, Bos taurus; identical to SEQ ID NO: 41513

SEQ ID NO: 122429 - DNA, 201 bp, Bos taurus; identical to SEQ ID NO: 41515

SEQ ID NO: 122430 - DNA, 201 bp, Bos taurus; identical to SEQ ID NO: 41516

SEQ ID NO: 122431 - DNA, 201 bp, Bos taurus; identical to SEQ ID NO: 41517

SEQ ID NO: 122432 - DNA, 201 bp, Bos taurus; identical to SEQ ID NO: 41518

SEQ ID NO: 122433 - DNA, 201 bp, Bos taurus; identical to SEQ ID NO: 41522

SEQ ID NO: 122434 - DNA, 201 bp, Bos taurus
taaactaactatgtataagagaatagtctggaaagttttaaggtagcattgaaagttttttttttttttttttttccctcccccagatgccagtagcaaayagaaaactgcaaccagggaggttcaactgaaaaaaaatcatattgtcatgtttactaaaataattcctgcttagtagcaagatctaagatcaaacagagt

SEQ ID NO: 122435 - DNA, 201 bp, Bos taurus; identical to SEQ ID NO: 41527

SEQ ID NO: 122436 - DNA, 201 bp, Bos taurus; identical to SEQ ID NO: 41529

SEQ ID NO: 122437 - DNA, 201 bp, Bos taurus; identical to SEQ ID NO: 41530

SEQ ID NO: 122438 - DNA, 201 bp, Bos taurus; identical to SEQ ID NO: 41532

SEQ ID NO: 122439 - DNA, 201 bp, Bos taurus
agtcttacatttaggcctttaatccatttgatattatttttatatatgatgttaaagaatcttctaaatctgtttgtttcttttttttttttttacatgtsgctctcagttttctcatcatcacctattgaagagactgccttttctccactgtatattcttgccttctttgttgtatttcaggtgaccataagtgcttga

SEQ ID NO: 122440 - DNA, 201 bp, Bos taurus
atcctttgaatgtgtctgcaactctcctaacattttccaaaaagtcaggcctctccagcagtcccatggtgccgttagaatagaacatgttccttgcctcygccttgtgtttctttcaggtcacttgctggcagctgggcattcatgcacagcatcatgttgaaattttcagatgagggctgtaagaacagcataatggag

SEQ ID NO: 122441 - DNA, 201 bp, Bos taurus
tgttatttgaccttttattttctctctgctgtttctccttttgcttttttccccctctccttatgccctgccatactggctttctttttctgtcacttaarcaggccagatatatttccaatcagcccctctgaacttgatataacatatgcataaaattcacctctcccaggtcagcctatagctgtcttcttctcattg

SEQ ID NO: 122442 - DNA, 201 bp, Bos taurus; identical to SEQ ID NO: 41538

SEQ ID NO: 122443 - DNA, 201 bp, Bos taurus
gaatatggggcacagcttcatgattttctcactaggtgtttttaacatttaatgagacaacttgttcacgatgtgttacaatatagcacagaggccaaggkaggtcaaagggtagaggtataatttgctgtgttttttgaagctgactttggctggttcgtgtgccttcgtttctggctggagacagaggcctgttttcca

SEQ ID NO: 122444 - DNA, 201 bp, Bos taurus; identical to SEQ ID NO: 41539

SEQ ID NO: 122445 - DNA, 201 bp, Bos taurus; identical to SEQ ID NO: 41540

SEQ ID NO: 122446 - DNA, 201 bp, Bos taurus; identical to SEQ ID NO: 81993

SEQ ID NO: 122447 - DNA, 201 bp, Bos taurus; identical to SEQ ID NO: 41541

SEQ ID NO: 122448 - DNA, 201 bp, Bos taurus; identical to SEQ ID NO: 41543

SEQ ID NO: 122449 - DNA, 201 bp, Bos taurus; identical to SEQ ID NO: 41544

SEQ ID NO: 122450 - DNA, 201 bp, Bos taurus
tgatgcagccaagaaaatacatgtaattcttttttttttttttttaattttcccctggatgttgtattcacatgaacttaattggtttacccaaattttgktgatcctccaccctaaaacttcaataggaattcaaatgcctctgcaattgggtataatcactataagtaaataaaagatgatgtggtggatggataagta

SEQ ID NO: 122451 - DNA, 201 bp, Bos taurus
ttttccacaaaaatgaactgctatttttcaaagccaatgaaaatgcaattgtggtacaaaaatattttggaggggttctaacattcatactaatttgtgtrtttggaaaagagttgtagttgggggagtcttcatacatgttcttagtcaacaaacactgtgaggctgcagttctaatcttttcttgctgtaaaaagtgag

SEQ ID NO: 122452 - DNA, 201 bp, Bos taurus
ccagggaaagagtgagtgcaggacagaacggaagggacctgggcaatgaccctggccttgacctggctaccccgggactccaagaggtggctggccctccrggactcaatgttccatctcctataaaaccaaattcgctgggtgaagtcacaaactttcaatgacggaatttgtttcaggcaaaatttcatgataaggcca

SEQ ID NO: 122453 - DNA, 201 bp, Bos taurus; identical to SEQ ID NO: 82046

SEQ ID NO: 122454 - DNA, 201 bp, Bos taurus; identical to SEQ ID NO: 41611

SEQ ID NO: 122455 - DNA, 201 bp, Bos taurus; identical to SEQ ID NO: 41613

SEQ ID NO: 122456 - DNA, 201 bp, Bos taurus
cagcaaaaaaaaaaaaaaagttattaaaaggagttaaaatgttcaagttcaggctttgaattctatctagctaactagtttataagggctgctggtcatcytaagattattccgctcttcccacaaagacctgcatcacttcctggcacctggatggggacccagcaggaggcgtcaggagatgcgacatttcccagccat

SEQ ID NO: 122457 - DNA, 201 bp, Bos taurus; identical to SEQ ID NO: 41614

SEQ ID NO: 122458 - DNA, 201 bp, Bos taurus; identical to SEQ ID NO: 41615

SEQ ID NO: 122459 - DNA, 201 bp, Bos taurus; identical to SEQ ID NO: 41616

SEQ ID NO: 122460 - DNA, 201 bp, Bos taurus; identical to SEQ ID NO: 82051

SEQ ID NO: 122461 - DNA, 201 bp, Bos taurus; identical to SEQ ID NO: 82052

SEQ ID NO: 122462 - DNA, 201 bp, Bos taurus; identical to SEQ ID NO: 82054

SEQ ID NO: 122463 - DNA, 201 bp, Bos taurus; identical to SEQ ID NO: 41619

SEQ ID NO: 122464 - DNA, 201 bp, Bos taurus; identical to SEQ ID NO: 82055

SEQ ID NO: 122465 - DNA, 201 bp, Bos taurus; identical to SEQ ID NO: 82058

SEQ ID NO: 122466 - DNA, 201 bp, Bos taurus; identical to SEQ ID NO: 41621

SEQ ID NO: 122467 - DNA, 201 bp, Bos taurus; identical to SEQ ID NO: 41623

SEQ ID NO: 122468 - DNA, 201 bp, Bos taurus
tcacacaggggcctgaatggagatcggagcagtgcctgcctgctgggagtcatagcctcggctcattttacttccactcatgctgggaacttttgctggcrtgggcccctggcacgctggtgtgccggtaacaaccagctttctgcaggagaaaaaacaaacccttatttaaagtctccaaaacgtggaggcaaccaagtt

SEQ ID NO: 122469 - DNA, 201 bp, Bos taurus; identical to SEQ ID NO: 41625

SEQ ID NO: 122470 - DNA, 201 bp, Bos taurus; identical to SEQ ID NO: 82063

SEQ ID NO: 122471 - DNA, 201 bp, Bos taurus; identical to SEQ ID NO: 41627

SEQ ID NO: 122472 - DNA, 201 bp, Bos taurus; identical to SEQ ID NO: 41629

SEQ ID NO: 122473 - DNA, 201 bp, Bos taurus; identical to SEQ ID NO: 41630

SEQ ID NO: 122474 - DNA, 201 bp, Bos taurus; identical to SEQ ID NO: 82065

SEQ ID NO: 122475 - DNA, 201 bp, Bos taurus; identical to SEQ ID NO: 82067

SEQ ID NO: 122476 - DNA, 201 bp, Bos taurus; identical to SEQ ID NO: 41632

SEQ ID NO: 122477 - DNA, 201 bp, Bos taurus; identical to SEQ ID NO: 41633

SEQ ID NO: 122478 - DNA, 201 bp, Bos taurus
tattcacctccaatgcctgggcagccagacagactggcttgtggagtcctcacagactcatgtttccattgaaatgtgttcaatgtgaactctctgtgagrgagcccaagactgctaatatctgaagcaaaaggctggtggaagaacctggaataaaattcttactctgaacaatctatggagattttatgattctctgat

SEQ ID NO: 122479 - DNA, 201 bp, Bos taurus; identical to SEQ ID NO: 82073

SEQ ID NO: 122480 - DNA, 201 bp, Bos taurus
tggtcagcagagcttggggaaggaactccccagggatgtcgagacaggctttccttctgtgtctccacaaatacatctcccgtgggccttcatcaaattaygcaaatctagatgtctttgcctgtcctccaggaaggctctcgccagaccctggctgaccttgacacggccaacctcaactcctctccctagttcctggct

SEQ ID NO: 122481 - DNA, 201 bp, Bos taurus; identical to SEQ ID NO: 82074

SEQ ID NO: 122482 - DNA, 201 bp, Bos taurus
cttcaatccctcactctctcctcttgggcgtctggttcttctctttcctttgacatccatacgctcagatcacaacctcttctcagcgcccttgggccccrtcagttcagccgatggacccttctccgtcttctctggtctccagctccctctcaacacacccagccccacttccctgctctcctctcctgtgcagagact

SEQ ID NO: 122483 - DNA, 201 bp, Bos taurus
ttccaggaaatcagtccaggttgtcctatgtgctggtctttgaagacaggtcccatgggctgatgaggggtcagtgcccttgtaagagaggccccagggayctccctcgccccttccacatgtgaggacacggcatctctgaatcagatggggagtctgctagaactttgctcttggcctccccagcctccacaccaggag

SEQ ID NO: 122484 - DNA, 201 bp, Bos taurus; identical to SEQ ID NO: 82076

SEQ ID NO: 122485 - DNA, 201 bp, Bos taurus; identical to SEQ ID NO: 82077

SEQ ID NO: 122486 - DNA, 201 bp, Bos taurus
aaaacaaggctgagcttcaaaacagggaagtgcttgcatctgttatataaaaactctgttccttgtgaaattgctttttcagtctaatgaaatggccccarattaaaacatacttccccaaaacaatggcagtgtttcatactgaaagttgctctttgcaaccctatggaatagttcatggaattctttaggccagaatac

SEQ ID NO: 122487 - DNA, 201 bp, Bos taurus
ggaacattttagagttttatgggacaaaatgtttggaagaaatacaggactttgattacatcattttgtagcagcgtaggtaaagttcgttgttggccaartaaaatattatcatgttaaatattactgagactaaggtgtggctttgtgatgttatgtgggttactattagtcttatgtatgtttggaaatatttgaaac

SEQ ID NO: 122488 - DNA, 201 bp, Bos taurus; identical to SEQ ID NO: 82079

SEQ ID NO: 122489 - DNA, 201 bp, Bos taurus
taggtgaggatggggatagctcagtaggcctgggaagcagagaatgacacatggaggtatattttggaccctctgctaatcatgactcttgacactggacrtttggacaaaggccccctctgtccctaattctgatctggcctctgctctccacttgctgtaattctgggtgtctttgggggagtccacttgaagacactg

SEQ ID NO: 122490 - DNA, 201 bp, Bos taurus
tgtgatcggattgcttacagactcctcacttcctttaggagaacaggccccaggaaagctgtaggtcagaggtttggctccagggactgtgccctccagtyacacctgcctcaccctgggggcccagctccataaccaagcagaccttggttttggaacttggcctcctttggcaggaccctgggtgaattccctcacttc

SEQ ID NO: 122491 - DNA, 201 bp, Bos taurus; identical to SEQ ID NO: 82083

SEQ ID NO: 122492 - DNA, 201 bp, Bos taurus
ccctaaatatctggtgaagagataacagaggagttaacaaaaggggggtagttctatggaggagattccaagccaagggaatttgtcttctgatggccatstgcttagcccagcaaaagaggtcctcacagctgtgttggagagagcagaggaggatccaaggagctgaagctggcccgggaggcagaggccagctggtgg

SEQ ID NO: 122493 - DNA, 201 bp, Bos taurus
tgccatctttgatgtttgcattatgctgtgggcccacgctggaaccaagcctagaaagcaaggcttcataacagcttaggaggcaggagaccagagacacrggatggaacaagatctcaggcccagggaacacagcatgctccctggtgacagaaggcccctcagagtggcacacagccttgggaaaggtggtaatgctaa

SEQ ID NO: 122494 - DNA, 201 bp, Bos taurus
tttgtctttttgaagactggtttccttgggctaaaggcccaggtgtgagaatgtcagatcctagctctggtcacttgagagttgttcccccgcggccccarcattcagagtgtcctttcgagtgactcttgccaatgtccatttccaccgactgtgtagggggttcccacccctcccagctctctcctacatgtattgcta

SEQ ID NO: 122495 - DNA, 201 bp, Bos taurus; identical to SEQ ID NO: 82086

SEQ ID NO: 122496 - DNA, 201 bp, Bos taurus; identical to SEQ ID NO: 82087

SEQ ID NO: 122497 - DNA, 201 bp, Bos taurus
ccaaaaggccttcaagggacacggagcttccgcttcctgccctttgggacattttcttttggcatgcttcctttctttcctagcccaaacaccttgctgcycgggggtgaggccacacaaaggggaaccaaggtgcgcttgctgactgtcaacatcaacgtcaactgccaaccaggaatgtgagctgtcttggatgttcta

SEQ ID NO: 122498 - DNA, 201 bp, Bos taurus
ctgacccctgcatggggagcttagtgtcttaaccactggaccaccagggaagtcccaagcaagcaaatctttttttcttatgttaatggccagcagagaarggctacacagagagagatctaacaagcaagggggcatgctggcttttcctgagggtctttcctgcatctccttcggccacactggtgctggtgcagtggg

SEQ ID NO: 122499 - DNA, 201 bp, Bos taurus; identical to SEQ ID NO: 82088

SEQ ID NO: 122500 - DNA, 201 bp, Bos taurus
aagctgcctcaaccctcaggctttagccaaagaaatgactccctaaaagtagacagccccattcccactgggaattggcaccgagagaggtaagaggtcargggtgaaaggtgagggcagaacaaagggtctcctgcctcctcgtcaccaagtgagccaagcgtcttcaccatgtcctcctgaggccatcctgcctattgc

SEQ ID NO: 122501 - DNA, 201 bp, Bos taurus
gagacgcactaacgcaaggccagaacacaggctggacacacaaggaggcccccaaataaagttagtctgaggagtgggaaagccagggccagcctgagacrccgattccagacagacctgccctgactcctccacgtgtgtgtcctgcagagaagctacgcagatgagctaacagggggccccctggagaactggagggga

SEQ ID NO: 122502 - DNA, 201 bp, Bos taurus
ggctggccaggcctccaggggcccagaaaattccaggaaatttcttctcttatataaggtgctacttgacatactggtagcaatttgtgtacctgcaagtrggcatgtaatccaggcccaattcaggcaaagttagatctgtcagaggcagctcctctacttctgaaacctaaacaagactacctcctcaatttaacttcc

SEQ ID NO: 122503 - DNA, 201 bp, Bos taurus; identical to SEQ ID NO: 82089

SEQ ID NO: 122504 - DNA, 201 bp, Bos taurus
tagaagctgagtcacctggccgggctccacccacccaggcttctgaagagaccctggacctcctgagacctgagtgctcagatataccctcagaggacagyatgctgaagggttttggccttctgcttgtccaacttgtcatttttcagaaaaatcaaggactgaaagcactaagagtgtggcttctggtcacccatattg

SEQ ID NO: 122505 - DNA, 201 bp, Bos taurus; identical to SEQ ID NO: 82091

SEQ ID NO: 122506 - DNA, 201 bp, Bos taurus; identical to SEQ ID NO: 82092

SEQ ID NO: 122507 - DNA, 201 bp, Bos taurus; identical to SEQ ID NO: 82093

SEQ ID NO: 122508 - DNA, 201 bp, Bos taurus; identical to SEQ ID NO: 82094

SEQ ID NO: 122509 - DNA, 201 bp, Bos taurus
gtaataaaaatagcttctatccatcctccgcatctcagaggaacattggcagtgaatttctgccctagggggatctctgtgaggcccttcaagttgaggtrattcctgttttccttccaccccaatcaccagctctctgccacccacaccaactgtgtcctttccagtcccatttgccaagttttgggccgtgtggatccc

SEQ ID NO: 122510 - DNA, 201 bp, Bos taurus
gccaacacacacctcgcaggactgctgctaccagtgcccctgtgcacgaggcaggccactgctgacacaagttgccacaggagaccctcaaaactcaagaytctggctcagtctcttgggggtcactgctccttcccccgggtcctgatgcatgcaaggatttgtttgtatcttccaagagtctctgtttcacccaatcct

SEQ ID NO: 122511 - DNA, 201 bp, Bos taurus
tggtcaattacatatgctatcttgctgtctccacacaagcctggcaaggcatgtcccccattgtacagatggaagaagtctcctccgatcttcttcatccrtactggagacaggcacataataatcccacaagtaatacatgttgactaaatgaatgggtgcatttacagatacttccaatagaacacattggtgcatcca

SEQ ID NO: 122512 - DNA, 201 bp, Bos taurus
tctcgacccagaaatcgaaccaatgtctcttaagtctccggcattgcaagctgattctttaccactgagccaccagggaagccctagaaggttttagcacrgtataaataaccagttgtgggcactgctatatttaaaatggataaccaaaaacaacttactgtgtagcacagggaactctgcttggtattatgtggcagc

SEQ ID NO: 122513 - DNA, 201 bp, Bos taurus; identical to SEQ ID NO: 82095

SEQ ID NO: 122514 - DNA, 201 bp, Bos taurus
aatctggggtttagacctcacagcagcccactgggtggtgaacaagttcactggttggccaaggcagagctggttcacagttgccaggcaagaaacaaccytctagggcacagatgagccaaggctgttgggcaggtgcacacagcatgccccacgtgcacaaggcctgcagcacacgatgtccatgccaggcatggaggg

SEQ ID NO: 122515 - DNA, 201 bp, Bos taurus
aacctggaagtcttttaatgtatctttgtctttatattgaagttgagcttcttatagatagcttatattgtcattctttttaatctgatcttatgtctttkcattggtgtgttttggccatttgcatataactaccagtgtgattgaattaaaacttaccatctttttgttgttgttgttttctatttctactgttttttg

SEQ ID NO: 122516 - DNA, 201 bp, Bos taurus; identical to SEQ ID NO: 82096

SEQ ID NO: 122517 - DNA, 201 bp, Bos taurus
accagagccatagactcggaggcacacacaggctggacacaagccatggccctcggaatggaccagccaccagcagccacggttggctacaacaggcagayaggacatgcatggagtatgccaggccctggagagaagacaccaggacccaacagcagggtgtgtgaacacacacacacacacaaacacacataaacacac

SEQ ID NO: 122518 - DNA, 201 bp, Bos taurus; identical to SEQ ID NO: 82099

SEQ ID NO: 122519 - DNA, 201 bp, Bos taurus; identical to SEQ ID NO: 82100

SEQ ID NO: 122520 - DNA, 201 bp, Bos taurus; identical to SEQ ID NO: 82101

SEQ ID NO: 122521 - DNA, 201 bp, Bos taurus; identical to SEQ ID NO: 82102

SEQ ID NO: 122522 - DNA, 201 bp, Bos taurus; identical to SEQ ID NO: 82103

SEQ ID NO: 122523 - DNA, 201 bp, Bos taurus; identical to SEQ ID NO: 82105

SEQ ID NO: 122524 - DNA, 201 bp, Bos taurus; identical to SEQ ID NO: 82106

SEQ ID NO: 122525 - DNA, 201 bp, Bos taurus; identical to SEQ ID NO: 82107

SEQ ID NO: 122526 - DNA, 201 bp, Bos taurus; identical to SEQ ID NO: 82113

SEQ ID NO: 122527 - DNA, 201 bp, Bos taurus
ctggtgaggagatgctggagacagaaaaatgagccattacttttagtactcgagaactacattaaaaaaccctggagcatttcgggcccacttctcagtartaagatgacatcactttttagttcaggcatatgcttgtcattttacattcatcatggagtggccagtgcaatttcaaccaccaagtcccatcccgatact

SEQ ID NO: 122528 - DNA, 201 bp, Bos taurus
accgcattggagaccttcgggccttcctgggccaagaggcaggcaacctagcgggtgagtccgggcgcccccatctccctccccgcgcgtcctcacctccyaccccatgggcccttggtttaaatggtcgccaacttcgagctctgttcccagattgactcagacggttctctaccctactcggtactggcgaccgctccc

SEQ ID NO: 122529 - DNA, 201 bp, Bos taurus
aagattgatcctgagaaaggtaccagggtgggccagagtccatgagcttcctgagcttagggataaaggtgaagaaaggtagagtgatggtcggtgggagytggccccagcggggaggatgtaggcctgggaggaggatctgattcgcaaggttacttagttttcagggcaccaggatgttggagtcaagttgggggccca

SEQ ID NO: 122530 - DNA, 201 bp, Bos taurus
ggcggcccagcctgtcaggggaggggaggcctgcagcaggggttttgaggaccagcaagggccaggccaaactgggagaggcgctggcctgggaccgtgaygtatcatgaggctgatgctgtatatcctcagtccagccccagttaggcgtgccaaccacccaccgtggccctcccgaattcagccaaggagtccccagtc

SEQ ID NO: 122531 - DNA, 201 bp, Bos taurus; identical to SEQ ID NO: 82115

SEQ ID NO: 122532 - DNA, 201 bp, Bos taurus
ctgaagctgaattaagaaataattgtgactataacctggatgtttggttttgcttaaaaacctcattagaggtaatacttccagatgagttaactaatctrtaaacctcaggtgatataatttgtgttgtgagacgtttgggttatcttgtacctggcagtggtcatccaaaagtaagagaacaactgtggcagccacaca

SEQ ID NO: 122533 - DNA, 201 bp, Bos taurus
ctctgtcacttccccaaatcagtagctcttcgagtggcttcagctgccttacactgtcacagcaagacaccgtggttttgattgaatgtggagaggcagaragccgtgtgaagtgcgagtgcctgggggttgtggggcagcaggaagttcaaggagagggagcccctctgggatgaaaggagccggggatgggagtagggg

SEQ ID NO: 122534 - DNA, 201 bp, Bos taurus
cagcagggcagccttgcagacctgctctcctcatcctcctgcctccccgatctcttctgcctccttccccacctcctcagacgctgctgtccgcgggcccygtctgtcccttttctgttccagccctgactctccacccaggtccaggtacgtcccccagagaagccctgccccccctgcctggaagcccaccccagcttc

SEQ ID NO: 122535 - DNA, 201 bp, Bos taurus
agggcccaggtaagagcaggcagaggccagcggccgggaggggactggatcttctgcctaggacgcccactgcccgcatccacggagggccctgcccagcmgaaagctcacagtgggacatggtcaggaaacacacaggcactgttctgcccgaagagcaggccagtttcctgagaaaggcctggccttaactgttgcacc

SEQ ID NO: 122536 - DNA, 201 bp, Bos taurus; identical to SEQ ID NO: 82120

SEQ ID NO: 122537 - DNA, 201 bp, Bos taurus; identical to SEQ ID NO: 82121

SEQ ID NO: 122538 - DNA, 201 bp, Bos taurus
cactctacccattgaaacccctgacgccatcttcagtagcatgcactctgggggcgttttcctcctcatgtctcactgcacaaccatgctacctgcccagygagacctgggcctgggcctgcctgtgttcacctcccatgaacctcccatggtatgttcactccggcagggatggggcctccctggatgcttacaaggcag

SEQ ID NO: 122539 - DNA, 201 bp, Bos taurus
acagccagggcctccattagctcacataaaaggtggttcccctcctccagacacatgcaaggctggggaacgcagtgcagaatggatttcagccctcagckgggggccctccagggaaacacacacacagctgcacctggctgcgccttgcagtgactgtgctgaccgctactggccatccacgacttctcacctcagcaa

SEQ ID NO: 122540 - DNA, 201 bp, Bos taurus
tagatgagaagaatttatctacgaagagactgtattttggggccaaatggggtgaactgacaagacatgatttcttgaggggcagcagggctcaggacacrgacattctctaacccggccaggagagttgaagatttgaggtcaggtacaggctccacctacccaaagtgttctgttaacaactggatccctgtatcttga

SEQ ID NO: 122541 - DNA, 201 bp, Bos taurus; identical to SEQ ID NO: 82123

SEQ ID NO: 122542 - DNA, 201 bp, Bos taurus; identical to SEQ ID NO: 82124

SEQ ID NO: 122543 - DNA, 201 bp, Bos taurus; identical to SEQ ID NO: 82125

SEQ ID NO: 122544 - DNA, 201 bp, Bos taurus; identical to SEQ ID NO: 82126

SEQ ID NO: 122545 - DNA, 201 bp, Bos taurus; identical to SEQ ID NO: 82128

SEQ ID NO: 122546 - DNA, 201 bp, Bos taurus; identical to SEQ ID NO: 82129

SEQ ID NO: 122547 - DNA, 201 bp, Bos taurus; identical to SEQ ID NO: 82130

SEQ ID NO: 122548 - DNA, 201 bp, Bos taurus
tacgggtaggtagtggtcagcacccggcagctgaggccccagcctcgggcctgcatgagtacctgccaagctgctcaagcctgtctgttcatccggcaacrcttccggtcttgtcttcatcccaggcctggctggacccgggggaaacgtgagggaaagctgggtgctgcctatgagcggccggcggcaaacacagtgact

SEQ ID NO: 122549 - DNA, 201 bp, Bos taurus; identical to SEQ ID NO: 82131

SEQ ID NO: 122550 - DNA, 201 bp, Bos taurus; identical to SEQ ID NO: 82135

SEQ ID NO: 122551 - DNA, 201 bp, Bos taurus; identical to SEQ ID NO: 82136

SEQ ID NO: 122552 - DNA, 201 bp, Bos taurus; identical to SEQ ID NO: 82137

SEQ ID NO: 122553 - DNA, 201 bp, Bos taurus; identical to SEQ ID NO: 82138

SEQ ID NO: 122554 - DNA, 201 bp, Bos taurus
ctgtgagccttgggggtgtcccgtgtccccaggtgcccagacttcctttcccagccctacccttgcagcagaagggccagcctggctttttagaaagagcmttttatttggaatgagaatatagagcccagtcctcctgcttcctcagaggagggagcaggagggctggcggggggtgggagaggtggcccctcacaatat

SEQ ID NO: 122555 - DNA, 201 bp, Bos taurus
gcaggatcctggttccctgaccagggatcgaacctgagccccagcagtgaaactgtcagctcctaaccactgaacggccagggagttccttcagtgactcyggctccctgaactcgctgtgccttaccctgctgcattttgatgtctgatccatagcacttcgctccacctcacagagcgtgttttgtgtgaggcccgtct

SEQ ID NO: 122556 - DNA, 201 bp, Bos taurus
tccgaccctcagcgaccccatggaccgcagcccaccaggctcctccgtccatgggattctccagacaagagtactggagtgggtgccataagggctaggcrcagtgagacaactgagtgttgatgtacagggagatggcagtccggctacagatgcacaataggctgatggaaagctgaagacaatgctgtcctagggcag

SEQ ID NO: 122557 - DNA, 201 bp, Bos taurus
tttttaatttataaaaagataaattgtatccccccacactcccaacccctcctttcctgccatcctttcaagtcaagggcctgggagctgggagagaaacygctggggctgtgccacggctccatgcctctgctctcacgacacaagagacctctggctgcccagaaaggagagaaagccgagctctggggaatcagcatg

SEQ ID NO: 122558 - DNA, 201 bp, Bos taurus
ggcttggccatttggacataacttcctggaggcatctagtttcctttcctgaaaatcaagggcaggggaacttctcgagcaggggttgaaaactgtggacyggaggccagactgcctgatgtgtgccactatcaaatgcttgggggtttctacacttacctttttgctgacctgcgtggctcatgggatcttagttcctca

SEQ ID NO: 122559 - DNA, 201 bp, Bos taurus; identical to SEQ ID NO: 82145

SEQ ID NO: 122560 - DNA, 201 bp, Bos taurus; identical to SEQ ID NO: 82146

SEQ ID NO: 122561 - DNA, 201 bp, Bos taurus; identical to SEQ ID NO: 82150

SEQ ID NO: 122562 - DNA, 201 bp, Bos taurus
cgcttcgattgtggggttgggcaggcagacagacggcccgagcacagccaatggcaggttctgtatgacgtgcgtgggagcctgactgtcttcacccacawtgctgggcccccaaggtatctggtgagcactcaccacggcgtgtgcgcagctgtctgactgtggtctcacccaccccaagcacgtgcctgtgggccctct

SEQ ID NO: 122563 - DNA, 201 bp, Bos taurus
ttggccagtcctgcttttttccctctgtagaaccatagctgctttgtcaggggccgaaagatgaaaggaagcattagggccaagggctgcccccatgtcaygcagagaagctggtgcatcagcccaggggctgcttctgtcaattcaggggcatcccagccttggcctttgtaagctgtgtgactctcagcaggttataaa

SEQ ID NO: 122564 - DNA, 201 bp, Bos taurus; identical to SEQ ID NO: 82154

SEQ ID NO: 122565 - DNA, 201 bp, Bos taurus; identical to SEQ ID NO: 82156

SEQ ID NO: 122566 - DNA, 201 bp, Bos taurus; identical to SEQ ID NO: 82157

SEQ ID NO: 122567 - DNA, 201 bp, Bos taurus; identical to SEQ ID NO: 82158

SEQ ID NO: 122568 - DNA, 201 bp, Bos taurus; identical to SEQ ID NO: 82160

SEQ ID NO: 122569 - DNA, 201 bp, Bos taurus
gtgaaaccacaactcgataccatcctacgcccaccagaggggctaaaatgcaaaacgcagacgatgccaagctcaggccagagcacggggccacggcgctytcacaggctgcccacgggggtgggagctgatgccagaaacttgagagctgcgagtcactgaaccaggcagacttgctgctctacccttgagacgcccggc

SEQ ID NO: 122570 - DNA, 201 bp, Bos taurus; identical to SEQ ID NO: 82162

SEQ ID NO: 122571 - DNA, 201 bp, Bos taurus
gctgctgcttgccgagactcacgtggtcggggggagggaccacttccattggactccatggttcgtcctgaaccagccccaaacagagcagacgggctaaygccaaaggcggcggcctggcccgaggccagggcagcacccagcccaggtcagcagctcagggcgggctgggaggaggccgtttctccctgtttccccact

SEQ ID NO: 122572 - DNA, 201 bp, Bos taurus; identical to SEQ ID NO: 82165

SEQ ID NO: 122573 - DNA, 201 bp, Bos taurus; identical to SEQ ID NO: 82166

SEQ ID NO: 122574 - DNA, 201 bp, Bos taurus
accgcacgatgctcatcgttttatgtgcgcaacgacaggaaagaggctaaattgaagagcacggacgctgatgatttaatgggagaaggggcccctcagckcggaggagacccagcgcgtgactcagaaggcagcacgttaccaaggagacgagccgctccgactcacccaaggccagtcacactgacagctgcccttacc

SEQ ID NO: 122575 - DNA, 201 bp, Bos taurus
ggcctgtcagcttttcctccgcgggaaacctcctccctggcccagggcacactggggatcgcagaacctcagctttgacgtccccatcaggcctgggaacrtgcaagttggctgcagcctcggtccatggcgtctctgacttcagagtaaccccctatgggggcccagatgccacccacgatgccactcccgggctctcac

SEQ ID NO: 122576 - DNA, 201 bp, Bos taurus
ccatggactgcagcccaccaggctcttctgtccatgggattttccaggtgtgcggtgccattggcttcaatcagagacttaagagagcccccgcaaaaaamaatacaaaatagcagcaagcaactgagggagtagacacaaacttcctgaggagctaggacggaggattcaaagtgttcacaatcccccaccttccgcact

SEQ ID NO: 122577 - DNA, 201 bp, Bos taurus
acctctgtgacaccctgtctccccgtctacagaacgggccacacccttcccaggtaccaaagggtgagcgccttctgtgctgtctcaggacctgctagagrgcatcacgccatcttgtaagccaccgtttcctcacggtggggaaaacacagactgccaaagcttctgagaagccattgcctgtccctccactgagtacac

SEQ ID NO: 122578 - DNA, 201 bp, Bos taurus; identical to SEQ ID NO: 82171

SEQ ID NO: 122579 - DNA, 201 bp, Bos taurus; identical to SEQ ID NO: 82173

SEQ ID NO: 122580 - DNA, 201 bp, Bos taurus; identical to SEQ ID NO: 82174

SEQ ID NO: 122581 - DNA, 201 bp, Bos taurus
catcgctcaaggacctgcccgcctggcgccccagcttctactccctggtgggtggctcaggtcatctcactggttcccattcagcatgtccggtgaacacrgcttgaagggcagagttacgagctttacaagaccaggcaggagagacatccccgagccggacaccacgtccaccccatcccccagcacaagccggtggaa

SEQ ID NO: 122582 - DNA, 201 bp, Bos taurus
gtgcacactcactgtggcacacacacacgcgttcccttggtgtacagtcacagtgcacactgtcacagtgcacactcactgtggccttcagcaagccagcrgcatgcccacgggtgccctgacagttctgacatcaatcatcaaagaccgaaacgtgggctgcggcccatttcctggaaatctccactgtttcccccaaat

SEQ ID NO: 122583 - DNA, 201 bp, Bos taurus; identical to SEQ ID NO: 41641

SEQ ID NO: 122584 - DNA, 201 bp, Bos taurus; identical to SEQ ID NO: 41642

SEQ ID NO: 122585 - DNA, 201 bp, Bos taurus; identical to SEQ ID NO: 41643

SEQ ID NO: 122586 - DNA, 201 bp, Bos taurus; identical to SEQ ID NO: 41644

SEQ ID NO: 122587 - DNA, 201 bp, Bos taurus; identical to SEQ ID NO: 41645

SEQ ID NO: 122588 - DNA, 201 bp, Bos taurus; identical to SEQ ID NO: 41646

SEQ ID NO: 122589 - DNA, 201 bp, Bos taurus; identical to SEQ ID NO: 41647
